US007842781B2

(12) United States Patent
Cole et al.

(10) Patent No.: US 7,842,781 B2
(45) Date of Patent: Nov. 30, 2010

(54) **METHOD FOR ISOLATING A POLYNUCLEOTIDE OF INTEREST FROM THE GENOME OF A *MYCOBACTERIUM* USING A BAC-BASED DNA LIBRARY. APPLICATION TO THE DETECTION OF MYCOBACTERIA**

(75) Inventors: Stewart Cole, Clamart (FR); Roland Buchrieser-Brosch, Paris (FR); Stephen Gordon, Guilford (GB); Alain Billault, Roissy en Brie (FR)

(73) Assignee: Institut Pasteur, Paris (FR)

( * ) Notice: Subject to any disclaimer, the term of this patent is extended or adjusted under 35 U.S.C. 154(b) by 1475 days.

(21) Appl. No.: 10/802,796

(22) Filed: Mar. 18, 2004

(65) Prior Publication Data

US 2005/0250104 A1 Nov. 10, 2005

Related U.S. Application Data

(60) Division of application No. 09/673,476, filed as application No. PCT/IB99/00740 on Apr. 16, 1999, now Pat. No. 7,112,663, which is a continuation of application No. 09/060,756, filed on Apr. 16, 1998, now Pat. No. 6,183,957.

(51) Int. Cl.
*C07K 14/00* (2006.01)
*C12Q 1/68* (2006.01)

(52) U.S. Cl. ............................ 530/324; 530/300; 435/6

(58) Field of Classification Search ........................ None
See application file for complete search history.

(56) References Cited

U.S. PATENT DOCUMENTS

| | | | |
|---|---|---|---|
| 6,183,957 | B1 | 2/2001 | Cole et al. |
| 6,492,506 | B1 | 12/2002 | Cole et al. |
| 2003/0198974 | A1 | 10/2003 | Cole et al. |

FOREIGN PATENT DOCUMENTS

| | | |
|---|---|---|
| WO | WO93/03187 | 2/1993 |
| WO | WO93/18186 | 9/1993 |
| WO | WO 9723624 | 7/1997 |
| WO | WO99/54487 | 10/1999 |

OTHER PUBLICATIONS

Rudinger J., Characteristics of the amino acids as components of a peptide hormone sequence, Peptide Hormones, J.A. Parsons, ed., Jun. 1976, 1-7.*

Designing Custom Peptides, Accessed from www.sigma-genosys.com/peptide_design.asp on Dec. 16, 2004, 1-2.*

Berendsen H.J.C., A Glipmpse of the Holy Grail?, Science, Oct. 1998, 282: 642-643.*

Voet D and Voet JG, Biochemistry Text Book, John Wiley & Sons, Inc., Second Edition, 1995, 235-241.*

Brosch et al., "Use of a *Mycobacterium tuberculosis* H37Rv Bacterial Aritificial Chromosome Library for Genome Mapping Sequencing, and Comparative Genomics," *Infection and Immunity*, vol. 66, No. 5, pp. 2221-2229 (May 1998).

Cole et al., "Deciphering the Biology of *Mycobacterium tuberculosis* from the Complete Genome Sequence," *Nature*, vol. 393, pp. 537-544 (Jun. 11, 1998).

Cole et al., "Analysis of the Genome of *Mycobacterium tuberculosis* H37Rv", Novartis Foundation Symposium, pp. 160-177 (1998).

Kim et al., "Construction and Characterization of a Human Bacterial Artificial Chromosome Library," *Genomics*, vol. 34, pp. 213-218 (Jun. 1, 1996).

Phillipp et al., "Physical Mapping of *Mycobacterium bovis* BCG Pasteur Reveals Differences from the Genome Map of *Mycobacterium tuberculosis* H37Rv and from *M. bovis*," *P.N.A.S.*, vol. 142:3135-3145 (1996).

Phillipp et al., "An Integrated Map of the Genome of the Tubercle Bacillus, *Mycobacterium tuberculosis* H37Rv, and Comparison with *Mycobacterium ieprae*," *Microbiology*, vol. 93:3132-3137 (1996).

Zimmer et al., "Construction and Characterization of Large-Fragmented Chicken Bacterial Artificial Chromosome Library", *Genomics*, vol. 42:217-226 (1997).

International Search Report of PCT/IB99/00740.

U.S. Appl. No. 09/060,756 and U.S. Appl. No. 09/670,314 (same disclosure).

GenEmbl AD00001.

GenEmbl AD000017.

GenEmbl U00013.

GenEmbl X63508 (Nov. 20, 1996).

GenBank Z79701[gi:1524225] (submitted Sep. 2, 1996; posted Sep. 6, 1996; replaced Jun. 27, 1998) (23 pages).

GenBank Z79701 Revision history (1 page).

* cited by examiner

*Primary Examiner*—Julie Ha
(74) *Attorney, Agent, or Firm*—Finnegan, Henderson, Farabow, Garrett & Dunner LLP

(57) ABSTRACT

The present invention is directed to a method for isolating a polynucleotide of interest that is present or is expressed in a genome of a first mycobacterium strain and that is absent or altered in a genome of a second mycobacterium strain which is different from the first mycobacterium strain using a bacterial artificial chromosome (BAC) vector. The invention further relates to a polynucleotide isolated by this method and recombinant BAC vector used in this method. In addition the present invention comprises method and kit for detecting the presence of a mycobacteria in a biological sample.

5 Claims, 9 Drawing Sheets

B

A

Figure 1A:
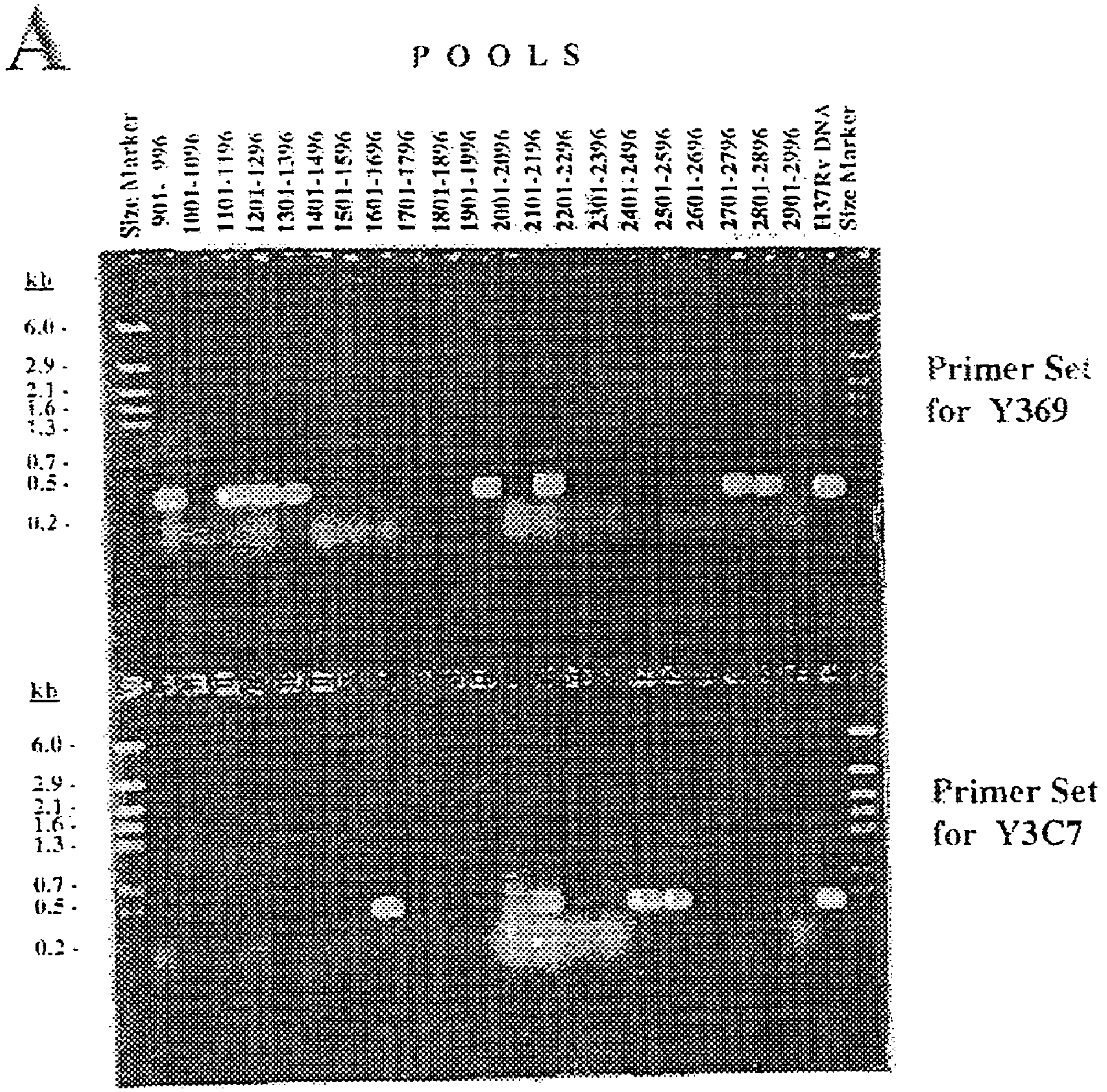

Figure 6:
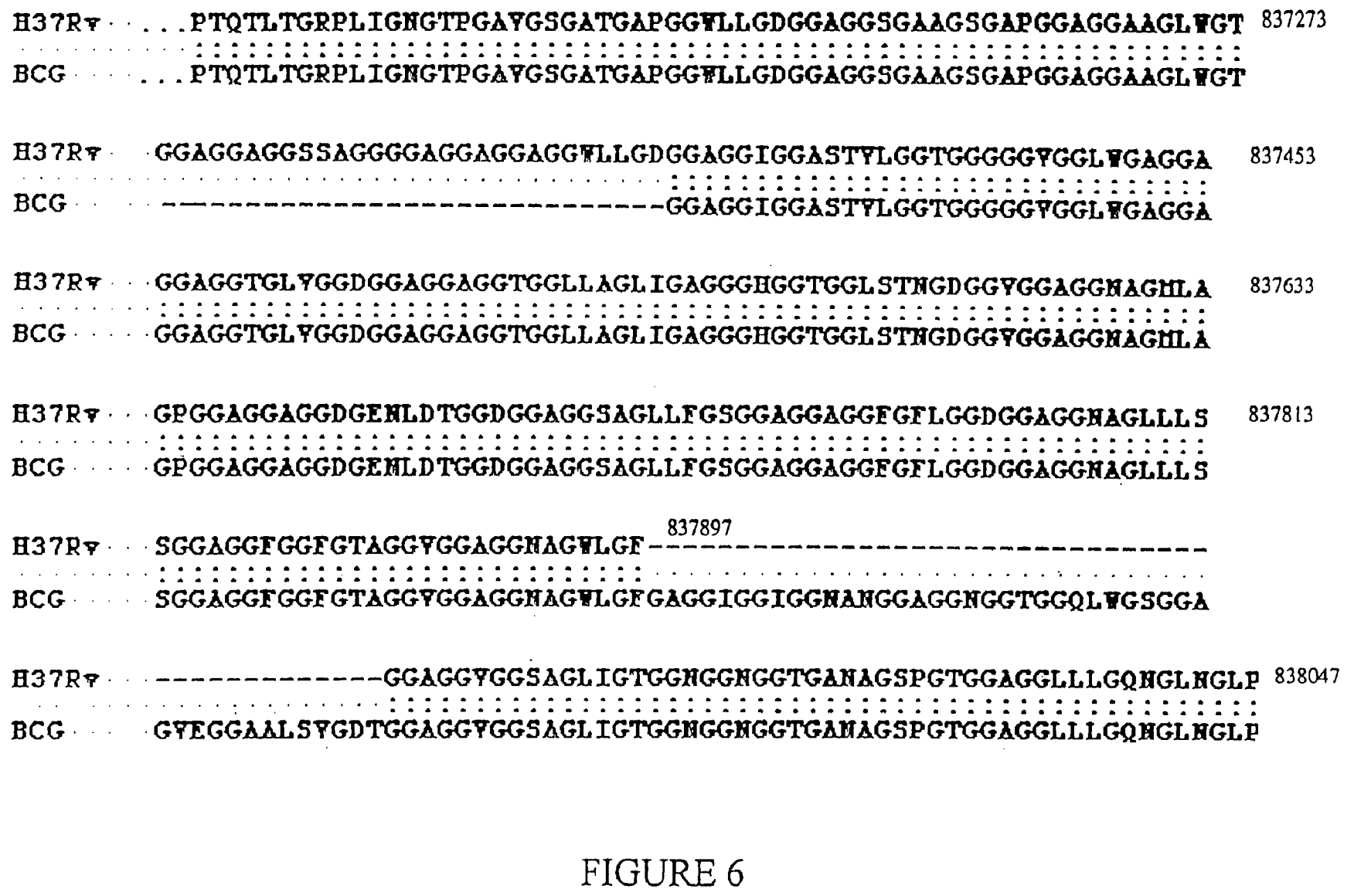

```
H37Rv ...PTQTLTGRPLIGNGTPGAVGSGATGAPGGWLLGDGGAGGSGAAGSGAPGGAGGAAGLWGT 837273
BCG   ...PTQTLTGRPLIGNGTPGAVGSGATGAPGGWLLGDGGAGGSGAAGSGAPGGAGGAAGLWGT

H37Rv GGAGGAGGSSAGGGGAGGAGGAGGWLLGDGGAGGIGGASTVLGGTGGGGVGGLWGAGGA 837453
BCG   --------------------------GGAGGIGGASTVLGGTGGGGVGGLWGAGGA

H37Rv GGAGGTGLVGGDGGAGGAGGTGGLLAGLIGAGGGHGGTGGLSTNGDGGVGGAGGNAGMLA 837633
BCG   GGAGGTGLVGGDGGAGGAGGTGGLLAGLIGAGGGHGGTGGLSTNGDGGVGGAGGNAGMLA

H37Rv GPGGAGGAGGDGEMLDTGGDGGAGGSAGLLFGSGGAGGAGGFGFLGGDGGAGGNAGLLLS 837813
BCG   GPGGAGGAGGDGEMLDTGGDGGAGGSAGLLFGSGGAGGAGGFGFLGGDGGAGGNAGLLLS

                                    837897
H37Rv SGGAGGFGGFGTAGGVGGAGGNAGWLGF-----------------------------
BCG   SGGAGGFGGFGTAGGVGGAGGNAGWLGFGAGGIGGIGGNANGGAGGNGGTGGQLWGSGGA

H37Rv -------------GGAGGVGGSAGLIGTGGNGGNGGTGANAGSPGTGGAGGLLLGQNGLNGLP 838047
BCG   GVEGGAALSVGDTGGAGGVGGSAGLIGTGGNGGNGGTGANAGSPGTGGAGGLLLGQNGLNGLP
```

FIGURE 6 pBeloBAC11

GCGGCCGCAA GGGGTTCGCG TCAGCGGGTG TTGGCGGGTG TCGGGGCTGG
*Not*I restriction site

CTTAACTATG CGGCATCAGA GCAGATTGTA CTGAGAGTGC ACCATATGCG

GTGTGAAATA CCGCACAGAT GCGTAAGGAG AAAATACCGC ATCAGGCGCC

ATTCGCCATT CAGGCTGCGC AACTGTTGGG AAGGGCGATC GGTGCGGGCC

TCTTCGCTAT TACGCCAGCT GGCGAAAGGG GGATGTGCTG CAAGGCGATT
primer T7-BAC1

AAGTTGGGTA ACGCCAGGGT TTTCCCAGTC ACGACGTTGT AAAACGACGG

CCAGTGAATT GTAATACGAC TCACTATAGG GCGAATTCGA GCTCGGTACC
T7-promoter sequence

CGGGGATCCT CTAGAGTCGA CCTGCAGGCA TGCAAGCTTG AGTATTCTAT
primer T7-Belo2 *Hin*dIII cloning site SP6-promoter AGTGTCACCT AAATAGCTTG GCGTAATCAT GGTCATAGCT GTTTCCTGTG
sequence (complementary strand) primer SP6-Mid (complementary strand)

TGAAATTGTT ATCCGCTCAC AATTCCACAC AACATACGAG CCGGAAGCAT

AAAGTGTAAA GCCTGGGGTG CCTAATGAGT GAGCTAACTC ACATTAATTG
primer SP6-BAC1 (complementary strand)

CGTTGCGCTC ACTGCCCGCT TTCCAGTCGG GAAACCTGTC GTGCCAGCTG

CATTAATGAA TCGGCCAACG CGAACCCCTT GCGGCCGCCC GGGCCGTCGA
*Not*I restriction site

FIGURE 7

METHOD FOR ISOLATING A POLYNUCLEOTIDE OF INTEREST FROM THE GENOME OF A *MYCOBACTERIUM* USING A BAC-BASED DNA LIBRARY. APPLICATION TO THE DETECTION OF MYCOBACTERIA

This application is a division of U.S. application Ser. No. 09/673,476, filed Nov. 30, 2000, now U.S. Pat. No. 7,112,663 which is a national stage application of PCT/IB99/00740, filed Apr. 16, 1999, which is a continuation of U.S. application Ser. No. 09/060,756, filed Apr. 16, 1998, now U.S. Pat. No. 6,183,957, all of which are incorporated herein by reference.

SEQUENCE LISTING

The instant application contains a "lengthy" Sequence Listing, which has been submitted via CD-R in lieu of a printed paper copy, and is hereby incorporated by reference in its entirety. Said CD-R, recorded on Nov. 30, 2006, are labeled CRF, "Copy 1" and "Copy 2", respectively, and each contains only one identical 524 Kb file (34950320.APP).

I. BACKGROUND OF THE INVENTION

The present invention pertains to a method for isolating a polynucleotide of interest that is present in the genome of a mycobacterium strain and/or is expressed by said mycobacterium strain and that is absent or altered in the genome of a different mycobacterium strain and/or is not expressed in said different mycobacterium strain, said method comprising the use of at least one clone belonging to a genomic DNA library of a given mycobacterium strain, said DNA library being cloned in a bacterial artificial chromosome (BAC). The invention concerns also polynucleotides identified by the above method, as well as detection methods for mycobacteria, particularly *Mycobacterium tuberculosis*, and kits using said polynucleotides as primers or probes. Finally, the invention deals with BAC-based mycobacterium DNA libraries used in the method according to the invention and particularly BAC-based *Mycobacterium tuberculosis* and *Mycobacterium bovis* BCG DNA libraries.

Radical measures are required to prevent the grim predictions of the World Health Organisation for the evolution of the global tuberculosis epidemic in the next century becoming a tragic reality. The powerful combination of genomics and bioinformatics is providing a wealth of information about the etiologic agent, *Mycobacterium tuberculosis*, that will facilitate the conception and development of new therapies. The start point for genome sequencing was the integrated map of the 4.4 Mb circular chromosome of the widely-used, virulent reference strain, *M. tuberculosis* H37Rv and appropriate cosmids were subjected to systematic shotgun sequence analysis at the Sanger Centre.

Cosmid clones (Balasubramanian et al., 1996; Pavelka et al., 1996) have played a crucial role in the *M. tuberculosis* H37Rv genome sequencing project. However, problems such as under-representation of certain regions of the chromosome, unstable inserts and the relatively small insert size complicated the production of a comprehensive set of canonical cosmids representing the entire genome.

II. SUMMARY OF THE INVENTION

In order to avoid the numerous technical constraints encountered in the state of the art, as described hereabove, when using genomic mycobacterial DNA libraries constructed in cosmid clones, the inventors have attempted to realize genomic mycobacterial DNA libraries in an alternative type of vectors, namely Bacterial Artificial Chromosome (BAC) vectors.

The success of this approach depended on whether the resulting BAC clones could maintain large mycobacterial DNA inserts. There are various reports describing the successful construction of a BAC library for eucaryotic organisms (Cai et al., 1995; Kim et al., 1996; Misumi et al., 1997; Woo et al., 1994; Zimmer et al., 1997) where inserts up to 725 kb (Zimmer et al., 1997) were cloned and stably maintained in the *E. coli* host strain.

Here, it is shown that, surprisingly, the BAC system can also be used for mycobacterial DNA, as 70% of the clones contained inserts in the size of 25 to 104 kb.

This is the first time that bacterial, and specifically mycobacterial, DNA is cloned in such BAC vectors.

In an attempt to obtain complete coverage of the genome with a minimal overlapping set of clones, a Bacterial Artificial Chromosome (BAC) library of *M. tuberculosis* was constructed, using the vector pBeloBAC11 (Kim et al., 1996) which combines a simple phenotypic screen for recombinant clones with the stable propagation of large inserts (Shizuya et al., 1992). The BAC cloning system is based on the *E. coli* F-factor, whose replication is strictly controlled and thus ensures stable maintenance of large constructs (Willets et al., 1987). BACs have been widely used for cloning of DNA from various eucaryotic species (Cai et al., 1995; Kim et al., 1996; Misumi et al., 1997; Woo et al., 1994; Zimmer et al., 1997). In contrast, to our knowledge this report describes the first attempt to use the BAC system for cloning bacterial DNA.

A central advantage of the BAC cloning system over cosmid vectors used in prior art is that the F-plasmid is present in only one or a maximum of two copies per cell, reducing the potential for recombination between DNA fragments and, more importantly, avoiding the lethal overexpression of cloned bacterial genes. However, the presence of the BAC as just a single copy means that plasmid DNA has to be extracted from a large volume of culture to obtain sufficient DNA for sequencing and it is described here in the examples a simplified protocol to achieve this.

Further, the stability and fidelity of maintenance of the clones in the BAC library represent ideal characteristics for the identification of genomic differences possibly responsible for phenotypic variations in different mycobacterial species.

As it will be shown herein, BACs can be allied with conventional hybridization techniques for refined analyses of genomes and transcriptional activity from different mycobacterial species.

Having established a reliable procedure to screen for genomic polymorphisms, it is now possible to conduct these comparisons on a more systematic basis than in prior art using representative BACs throughout the chromosome and genomic DNA from a variety of mycobacterial species.

As another approach to display genomic polymorphisms, the inventors have also started to use selected H37Rv BACs for "molecular combing" experiments in combination with fluorescent in situ hybridization (Bensimon et al., 1994; Michalet et al., 1997). With such techniques the one skilled in the art is enabled to explore the genome of mycobacteria in general and of *M. tuberculosis* in particular for further polymorphic regions.

The availability of BAC-based genomic mycobacterial DNA libraries constructed by the inventors have allowed them to design methods and means both useful to identify genomic regions of interest of pathogenic mycobacteria, such as *Mycobacterium tuberculosis*, that have no counterpart in the corresponding non-pathogenic strains, such as *Mycobacterium bovis* BCG, and useful to detect the presence of polynucleotides belonging to a specific mycobacterium strain in a biological sample.

By a biological sample according to the present invention, it is notably intended a biological fluid, such as plasma, blood, urine or saliva, or a tissue, such as a biopsy.

Thus, a first object of the invention consists of a method for isolating a polynucleotide of interest that is present in the genome of a mycobacterium strain and/or is expressed by said mycobacterium strain and that is absent or altered in the genome of a different mycobacterium strain and/or is not expressed in said different mycobacterium strain, said method comprising the use of at least one clone belonging to a genomic DNA library of a given mycobacterium strain, said DNA library being cloned in a bacterial artificial chromosome (BAC).

The invention is also directed to a polynucleotide of interest that has been isolated according to the above method and in particular a polynucleotide containing one or several Open Reading Frames (ORFs), for example ORFs encoding either a polypeptide involved in the pathogenicity of a mycobacterium strain or ORFs encoding Polymorphic Glycine Rich Sequences (PGRS).

Such polynucleotides of interest may serve as probes or primers in order to detect the presence of a specific mycobacterium strain in a biological sample or to detect the expression of specific genes in a particular mycobacterial strain of interest.

The BAC-based genomic mycobacterial DNA libraries generated by the present inventors are also part of the invention, as well as each of the recombinant BAC clones and the DNA insert contained in each of said recombinant BAC clones.

The invention also pertains to methods and kits for detecting a specific mycobacterium in a biological sample using either at least one recombinant BAC clone or at least one polynucleotide according to the invention, as well as to methods and kits to detect the expression of one or several specific genes of a given mycobacterial strain present in a biological sample.

III. BRIEF DESCRIPTION OF THE FIGURES

In order to better understand the present invention, reference will be made to the appended figures which depicted specific embodiments to which the present invention is in no case limited in scope with.

Figure 1B:
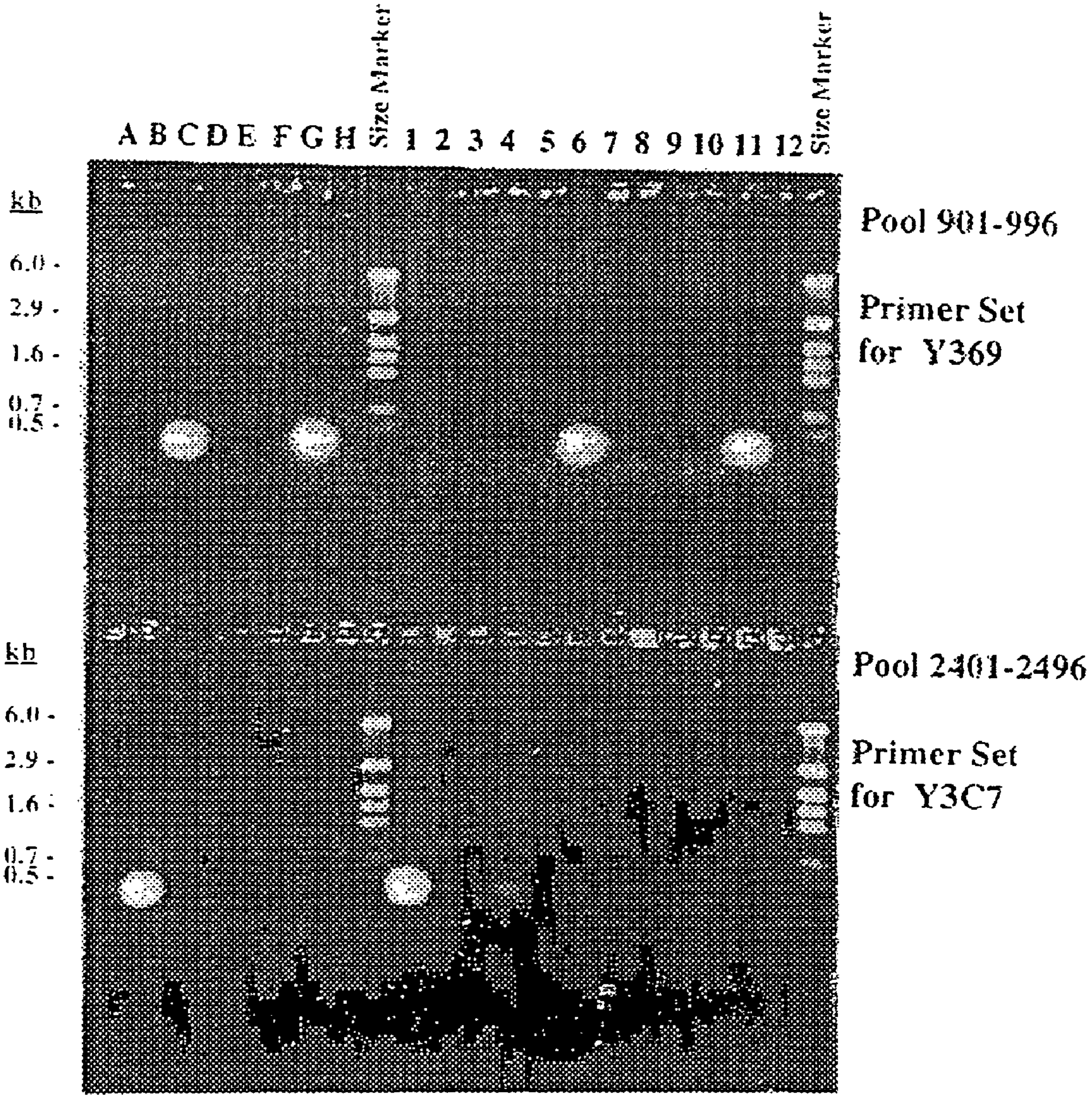

FIGS. 1A and 1B: PCR-screening for unique BAC clones with specific primers for 2 selected genomic regions of the H37Rv chromosome, using 21 pools representing 2016 BACs (FIG. 1A) and sets of 20 subpools from selected positive pools (FIG. 1B).

Figure 2:
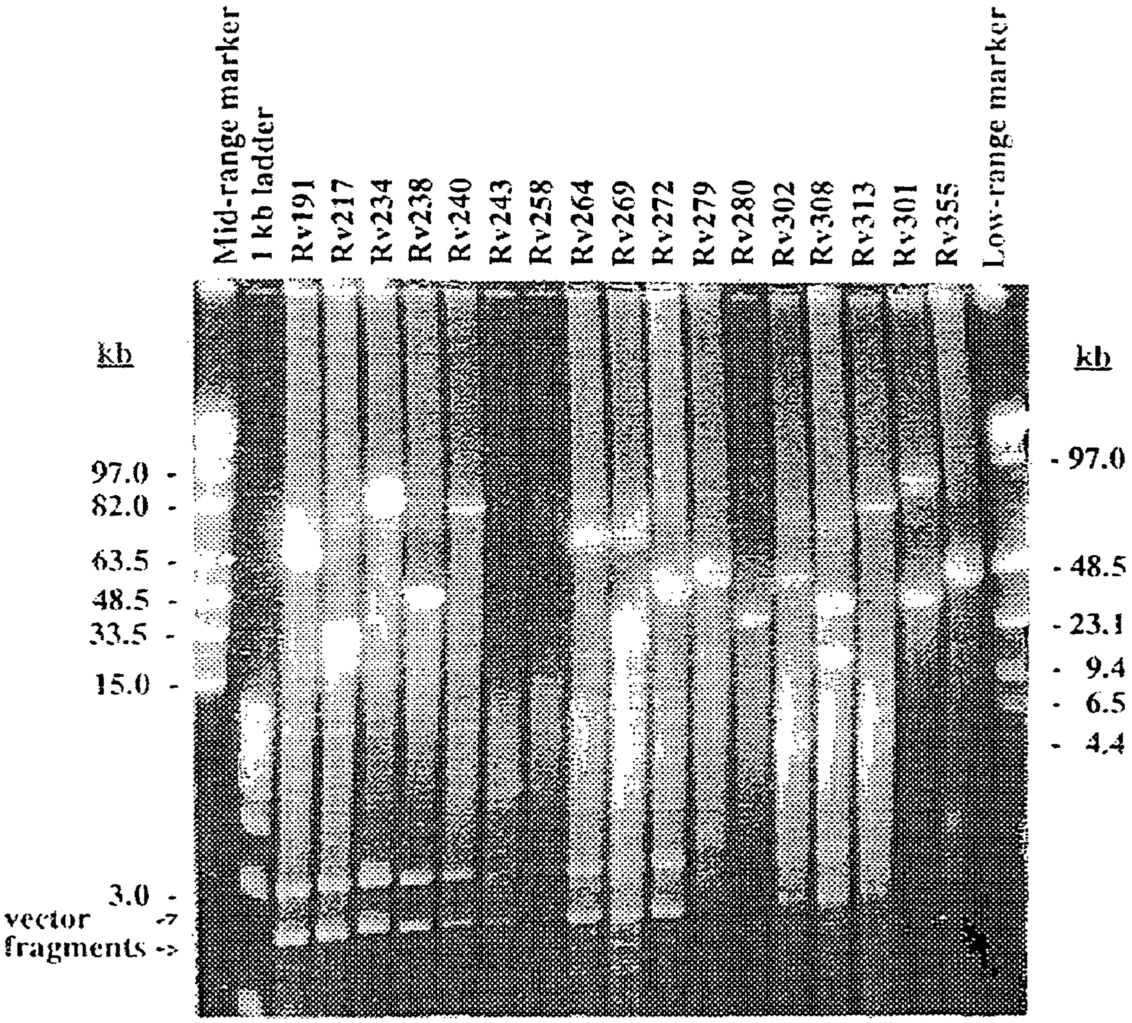

FIG. 2: Pulsed-field gel electrophoresis gel of DraI-cleaved BAC clones used for estimating the insert sizes of BACs.

Figure 3:
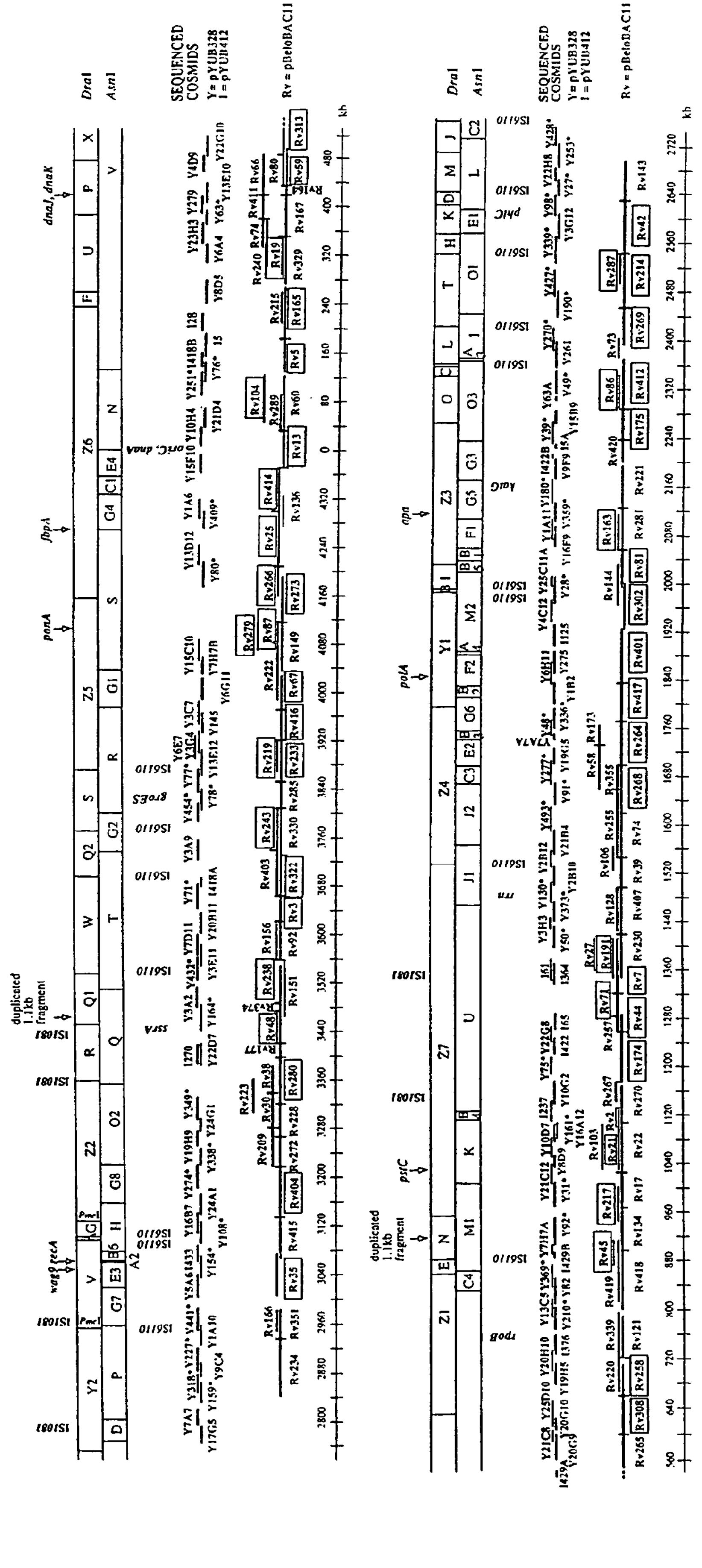

FIG. 3: Minimal overlapping BAC map of *M. tuberculosis* H37Rv superimposed on the integrated physical and genetic map established by Philipp et al. (18). Y- and I-numbers show pYUB328 (2) and pYUB412 (16) cosmids which were shotgun sequenced during the H37Rv genome sequencing project. Y-cosmids marked with * were shown in the integrated physical and genetic map (18). Rv numbers show the position of representative BAC clones relative to sequenced Y- and I-clones. Squared Rv numbers show BACs which were shotgun sequenced at the Sanger Centre.

Figure 4A:
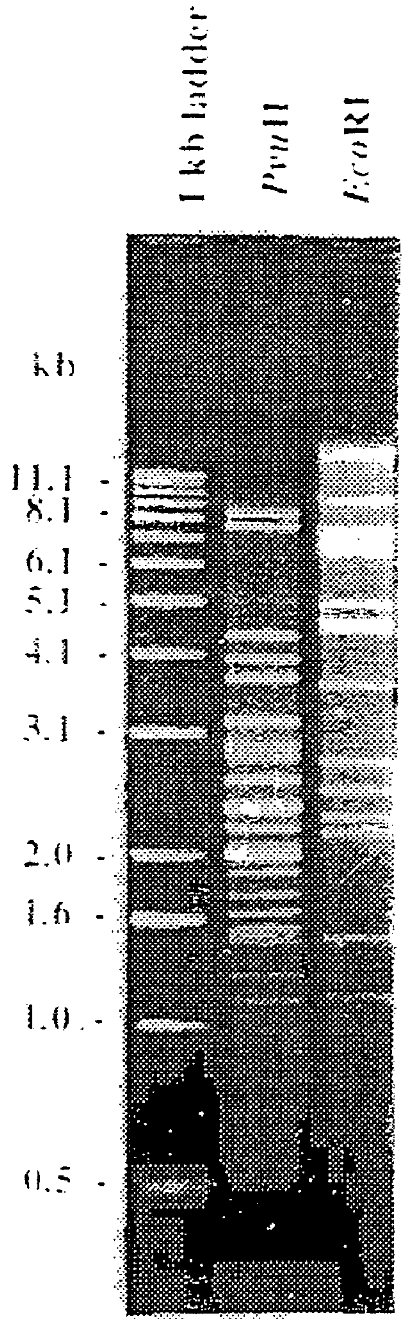
Figure 4B:
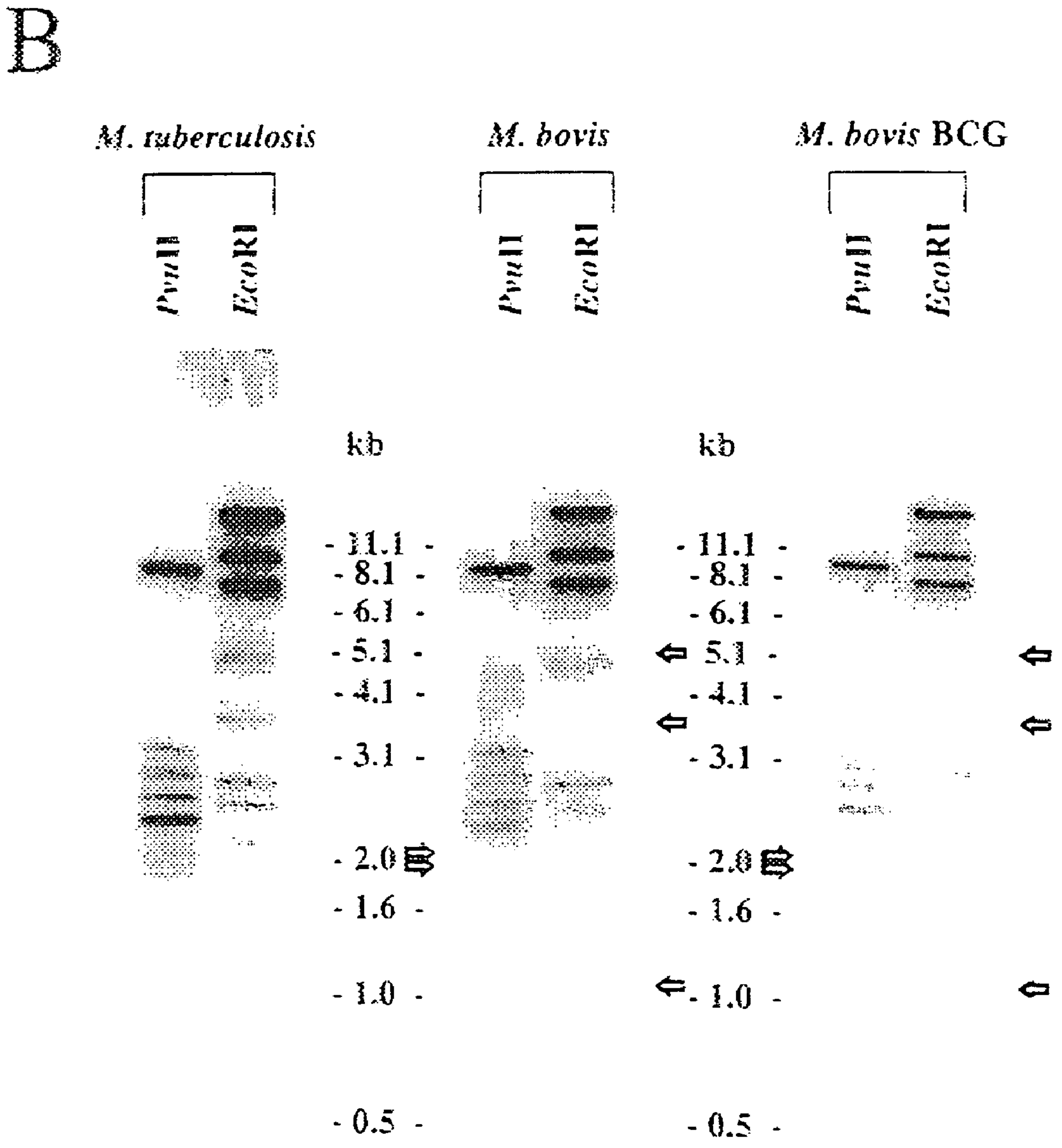

FIGS. 4A and 4B: Ethidium bromide stained gel (FIG. 4A) and corresponding Southern blot (FIG. 4B) of EcoRI and PvuII digested Rv58 DNA hybridized with $^{32}P$ labeled genomic DNA preparations from *M. tuberculosis* H37Rv, *M. bovis* ATCC 19210 and *M. bovis* BCG Pasteur.

Figure 5:
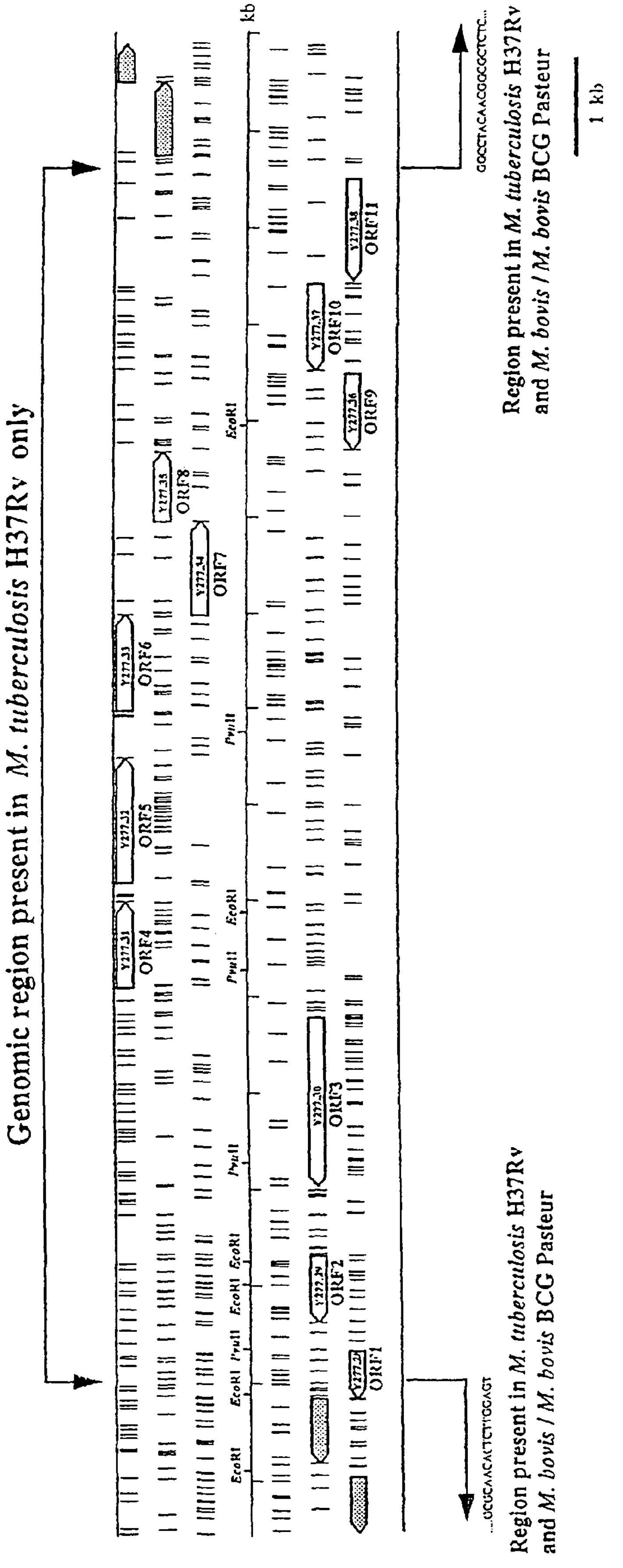

FIG. 5: Organisation of the ORFs in the 12.7 kb genomic region present in *M. tuberculosis* H37Rv but not present in *M. bovis* ATCC 19210 and *M. bovis* BCG Pasteur. Arrows show the direction of transcription of the putative genes. Positions of EcoRI and PvuII restriction sites are shown. Vertical dashes represent stop codons. The 11 ORFs correspond to the ORFs MTCY277.28 to MTCY277.38/accession number Z79701-EMBL Nucleotide Sequence Data Library. The junction sequences flanking the polymorphic region are shown (SEQ ID NOS 754 & 755 are disclosed, respectively, in order of appearance).

FIG. 6: Variation in the C-terminal part of a PE-PGRS open reading frame in *M. tuberculosis* strain H37Rv (SEQ ID NO: 727) relative to *M. bovis* BCG strain Pasteur (SEQ ID NO: 728).

The numbers on the right side of the Figure denote the position of the end nucleotides, taking as the reference the *M. tuberculosis* genome.

FIG. 7: Polynucleotide sequence next to the HindIII cloning site in the BAC vector pBeloBAC11 (Kim et al., 1996) used to clone the inserts of the BAC-based mycobacterial genomic DNA library according to the invention (SEQ ID NO: 29).

NotI: location of the NotI restriction sites.

Primer T7-BAC1: nucleotide region recognized by the T7-BAC1 primer shown in Table 1.

T7 promoter: location of the T7 promoter region on the pBeloBac11 vector.

Primer T7-Belo2: nucleotide region recognized by the T7-Belo2 primer shown in Table 1.

HindIII: the HindIII cloning site used to clone the genomic inserts in the pBeloBAC11 vector.

SP6-Mid primer: nucleotide region recognized by the SP6 Mid primer shown in Table 1.

SP6-BAC1 primer: nucleotide region recognized by the SP6 BAC1 primer shown in Table 1.

SP6 promoter: location of the SP6 promoter region on the pBeloBac11 vector.

IV. DETAILED DESCRIPTION OF THE PREFERRED EMBODIMENTS

As already mentioned hereinbefore, the present invention is directed to a method for isolating a polynucleotide of interest that is present in the genome of a mycobacterium strain and/or is expressed by said mycobacterium strain and that is absent or altered in the genome of a different mycobacterium strain and/or is not expressed in said different mycobacterium strain, said method comprising the use of at least one clone belonging to a genomic DNA library of a given mycobacterium strain, said DNA library being cloned in a bacterial artificial chromosome (BAC) type vector.

For this purpose, the inventors have constructed several BAC-based mycobacterial genomic DNA libraries that may be used in order to perform the above described method.

Because it is the first time that mycobacterial genomic, DNA has been successfully cloned in BAC type vectors, and because these DNA libraries are then novel and nonobvious, an object of the present invention consists in a mycobacterial genomic DNA library cloned in such a BAC type vector.

As an illustrative example, a BAC-based DNA library of *Mycobacterium tuberculosis* has been realized. Forty-seven cosmids chosen from the integrated map of the 4.4 Mb circular chromosome (Philipp et al., 1996a) were shotgun-sequenced during the initial phase of the H37Rv genome sequence project. The sequences of these clones were used as landmarks in the construction of a minimally overlapping BAC map. Comparison of the sequence data from the termini of 420 BAC clones allowed us to establish a minimal overlapping BAC map and to fill in the existing gaps between the sequence of cosmids. As well as using the BAC library for genomic mapping and sequencing, we also tested the system in comparative genomic experiments in order to uncover differences between two closely related mycobacterial species. As shown in a previous study (Philipp et al., 1996b), *M. tuberculosis, M. bovis* and *M. bovis* BCG, specifically BCG Pasteur strain, exhibit a high level of global genomic conservation, but certain polymorphic regions were also detected. Therefore, it was of great interest to find a reliable, easy and rapid way to exactly localize polymorphic regions in mycobacterial genomes using selected BAC clones. This approach was validated by determining the exact size and location of the polymorphisms in the genomic region of DraI fragment Z4 (Philipp et al., 1996b), taking advantage of the availability of an appropriate BAC clone covering the polymorphic region and the H37Rv genome sequence data. This region is located approximately 1.7 Mb from the origin of replication.

The Bacterial Artificial Chromosome (BAC) cloning system is capable of stably propagating large, complex DNA inserts in *Escherichia coli*. As part of the *Mycobacterium tuberculosis* H37Rv genome sequencing project, a BAC library was constructed in the pBeloBAC11 vector and used for genome mapping, confirmation of sequence assembly, and sequencing. The library contains about 5000 BAC clones, with inserts ranging in size from 25 to 104 kb, representing theoretically a 70 fold coverage of the *M. tuberculosis* genome (4.4 Mb). A total of 840 sequences from the T7 and SP6 termini of 420 BACs were determined and compared to those of a partial genomic database. These sequences showed excellent correlation between the estimated sizes and positions of the BAC clones and the sizes and positions of previously sequenced cosmids and the resulting contigs. Many BAC clones represent linking clones between sequenced cosmids, allowing full coverage of the H37Rv chromosome, and they are now being shotgun-sequenced in the framework of the H37Rv sequencing project. Also, no chimeric, deleted or rearranged BAC clones were detected, which was of major importance for the correct mapping and assembly of the H37Rv sequence. The minimal overlapping set contains 68 unique BAC clones and spans the whole H37Rv chromosome with the exception of a single gap of ~150 kb. As a post-genomic application, the canonical BAC set was used in a comparative study to reveal chromosomal polymorphisms between *M. tuberculosis, M. bovis* and *M. bovis* BCG Pasteur, and a novel 12.7 kb segment present *M. tuberculosis* but absent from *M. bovis* and *M. bovis* BCG was characterized. This region contains a set of genes whose products show low similarity to proteins involved in polysaccharide biosynthesis. The H37Rv BAC library therefore provides the one skilled in the art with a powerful tool both for the generation and confirmation of sequence data as well as for comparative genomics and a plurality of post-genomic applications.

The above described BAC-based *Mycobacterium tuberculosis* genomic DNA library is part of the present invention and has been deposited in the Collection Nationale de Cultures de Microorganismes (CNCM) on Nov. 19, 1997 under the accession number 1-1945.

Another BAC-based DNA library has been constructed with the genomic DNA of *Mycobacterium bovis* BCG, Pasteur strain, and said DNA library has been deposited in the Collection Nationale de Cultures de Microorganismes (CNCM) on Jun. 30, 1998 under the accession number I-2049.

Thus, as a specific embodiment of the above described method for isolating a polynucleotide of interest said method makes use of at least one BAC-based DNA library that has been constructed from the genomic DNA of *Mycobacterium tuberculosis*, more specifically of the H37Rv strain and particularly of the DNA library deposited in the accession number 1-1945.

In another specific embodiment of the above described method for isolating a polynucleotide of interest said method makes use of at least one BAC-based DNA library has been constructed from the genomic DNA of *Mycobacterium bovis* BCG, more specifically of the Pasteur strain and particularly of the DNA library deposited in the accession number I-2049.

In more details, the method according to the invention for isolating a polynucleotide of interest may comprise the following steps:

a) isolating at least one polynucleotide contained in a clone of a BAC-based DNA library of mycobacterial origin;

b) isolating:

at least one genomic or cDNA polynucleotide from a mycobacterium, said mycobacterium belonging to a strain different from the strain used to construct the BAC-based DNA library of step a); or alternatively at least one polynucleotide contained in a clone of a BAC-based DNA library prepared from the genome of a mycobacterium that is different from the mycobacterium used to construct the BAC-based DNA library of step a);

c) hybridizing the at least one polynucleotide of step a) to the at least one polynucleotide of step b);

d) selecting the at least one polynucleotide of step a) that has not formed a hybrid complex with the at least one polynucleotide of step b);

e) characterizing the selected polynucleotide.

Following the above procedure, the at least one polynucleotide of step a) may be prepared as follows:

1) digesting at least one recombinant BAC clone by an appropriate restriction endonuclease in order to isolate the polynucleotide insert of interest from the vector genetic material;

2) optionally amplifying the resulting polynucleotide insert;

3) optionally digesting the polynucleotide insert of step 1) or step 2) with at least one restriction endonuclease.

The above method of the invention allows the one skilled in the art to perform comparative genomics between different strains or species of mycobacteria cells, for example between pathogenic strains or species and their non pathogenic strains or species counterparts, as it is the illustrative case for the genomic comparison between *Mycobacterium tuberculosis* and *Mycobacterium bovis* BCG that is described herein in the examples.

Restriction digests of a given clone of a BAC library according to the invention may be blotted to membranes, and then probed with radiolabeled DNA form another strain or another species of mycobacteria, allowing the one skilled in the art to identify, characterize and isolate a polynucleotide of interest that may be involved in important metabolical and/or physiological pathways of the mycobacterium under testing, such as a polynucleotide functionally involved in the pathogenicity of said given mycobacteria for its host organism.

More specifically, the inventors have shown in Example 6 that when restriction digests of a given clone of the BAC library identified by the CNCM accession number 1-1945 are blotted to membranes and then probed with radiolabeled total genomic DNA from, for example, *Mycobacterium bovis* BCG Pasteur, it is observed that restriction fragments that fail to hybridize with the *M. bovis* BCG Pasteur DNA are absent from its genome, hence identifying polymorphic regions between *M. bovis* BCG Pasteur and *M. tuberculosis* H37Rv.

Thus, a further object of the present invention consists in a polynucleotide of interest that has been isolated according to the method described herein before.

In Example 6, a polynucleotide of approximately 12.7 kilobases has been isolated that is present in the genome of *M. tuberculosis* but is absent of the genome of *M. bovis* BCG. This polynucleotide of interest contains 11 ORFs that may be involved in polysaccharide biosynthesis. In particular, two of said ORFs are of particular interest namely ORF6 (MTCY277.33; Rv1511) that encodes a protein that shares significant homology with bacterial GDP-D-mannose dehydratases, whereas the protein encoded by ORF7 (MTCY277.34; Rv1512) shares significant homology with a nucleotide sugar epimerase. As polysaccharide is a major constituent of the mycobacterial cell wall, these deleted genes may cause the cell wall of *M. bovis* BCG to differ from that of *M. tuberculosis*, a fact that may have important consequences for both the immune response to *M. bovis* BCG and virulence. Detection of such a polysaccharide is of diagnostic interest and possibly useful in the design of tuberculosis vaccines.

Consequently, the polynucleotide of interest obtained following the method according to the invention may contain at least one ORF, said ORF preferably encoding all or part of a polypeptide involved in an important metabolical and/or physiological pathway of the mycobacteria under testing, and more specifically all or part of a polypeptide that is involved in the pathogenicity of the mycobacteria under testing, such as for example *Mycobacterium tuberculosis*, and more generally mycobacteria belonging to the *Mycobacterium tuberculosis* complex.

The *Mycobacterium tuberculosis* complex has its usual meaning, i.e. the complex of mycobacteria causing tuberculosis which are *Mycobacterium tuberculosis, Mycobacterium bovis, Mycobacterium africanum, Mycobacterium microti* and the vaccine strain *Mycobacterium bovis* BCG.

An illustrative polynucleotide of interest according to the present invention comprises all or part of the polynucleotide of approximately 12.7 kilobases that is present in the genome of *M. tuberculosis* but is absent from the genome of *M. bovis* BCG disclosed hereinbefore. This polynucleotide is contained in clone Rv58 of the BAC DNA library I-1945.

Generally, the invention also pertains to a purified polynucleotide comprising the DNA insert contained in a recombinant BAC vector belonging to a BAC-based mycobacterial genomic DNA library, such as for example the I-1945 BAC DNA library.

Advantageously, such a polynucleotide has been identified according to the method of the invention.

Such a polynucleotide of interest may be used as a probe or a primer useful for specifically detecting a given mycobacterium of interest, such as *Mycobacterium tuberculosis* or *Mycobacterium bovis* BCG.

More specifically, the invention then deals with a purified polynucleotide useful as probe or a primer comprising all or part of the nucleotide sequence SEQ ID No 1.

The location, on the *Mycobacterium tuberculosis* chromosome, of the above polynucleotide of sequence SEQ ID No 1 has now been ascribed to begin, at its 5' end at nucleotide at position nt 1696015 and to end, at its 3' end, at nucleotide at position nt 1708746.

For diagnostic purposes, this 12.7 kb deletion should allow a rapid PCR screening of tubercle isolates to identify whether they are bovine or human strains. The primers listed in Table I are flanking the deleted region and give a 722 bp amplicon in *M. bovis* or *M. bovis* BCG strains, but a fragment of 13,453 bp in *M. tuberculosis* that is practically impossible to amplify under the same PCR conditions. More importantly, assuming that some of the gene products from this region represent proteins with antigenic properties, it could be possible to develop a test that can reliably distinguish between the immune response induced by vaccination with *M. bovis* BCG vaccine strains and infection with *M. tuberculosis* or that the products (e.g. polysaccharides) are specific immunogens.

The invention also provides for a purified polynucleotide useful as a probe or as a primer, said polynucleotide being chosen in the following group of polynucleotides:

a) a polynucleotide comprising at least 8 consecutive nucleotides of the sequence SEQ ID No 1;

b) a polynucleotide whose sequence is fully complementary to the sequence of the polynucleotide defined in a);

c) a polynucleotide that hybridizes under stringent hybridization conditions with the polynucleotide defined in a) or with the polynucleotide defined in b).

For the purpose of defining a polynucleotide or oligonucleotide hybridizing under stringent hybridization conditions, such as above, it is intended a polynucleotide that hybridizes with a reference polynucleotide under the following hybridization conditions.

The hybridization step is realized at 65° C. in the presence of 6×SSC buffer, 5×Denhardt's solution, 0.5% SDS and 100 μg/ml of salmon sperm DNA.

For technical information, 1×SSC corresponds to 0.15 M NaCl and 0.05M sodium citrate; 1×Denhardt's solution corresponds to 0.02% Ficoll, 0.02% polyvinylpyrrolidone and 0.02% bovine serum albumin.

The hybridization step is followed by four washing steps two washings during 5 min, preferably at 65° C. in a 2×SSC and 0.1% SDS buffer, one washing during 30 min, preferably at 65° C. in a 2×SSC and 0.1% SDS buffer, one washing during 10 min, preferably at 65° C. in a 0.1×SSC and 0.1% SDS buffer.

A first illustrative useful polynucleotide that is included in the polynucleotide of sequence SEQ ID No 1 is the polynucleotide of sequence SEQ ID No 2 that corresponds to the Sp6 end-sequence of SEQ ID No 1.

A second illustrative useful polynucleotide that is included in the polynucleotide of sequence SEQ ID No 1 is the polynucleotide of sequence SEQ ID No 3 that corresponds to the T7 end-sequence of SEQ ID No 1, located on the opposite strand.

The polynucleotide of sequence SEQ ID No 1 contains 11 ORFs, the respective locations of which, taking into account the orientation of each ORF on the chromosome, on the sequence of the *Mycobacterium tuberculosis* chromosome, is given hereafter:

The location of ORF1 is comprised between nucleotide at position nt 1695944 and nucleotide at position nt 1696441.

The location of ORF2 is comprised between nucleotide at position nt 1696728 and nucleotide at position nt1697420 (SEQ ID NO: 744).

The location of ORF3 is comprised between nucleotide at position nt 1698096 and nucleotide at position nt1699892. ORF3 probably encodes a protein having the characteristics of a membrane protein (SEQ ID NO: 745).

The location of ORF4 is comprised between nucleotide at position nt 1700210 and nucleotide at position nt1701088 (SEQ ID NO: 746).

The location of ORF5 is comprised between nucleotide at position nt 1701293 and nucleotide at position nt1702588. ORF5 encodes a protein having the characteristics of a membrane protein (SEQ ID NO: 747).

The location of ORF6 is comprised between nucleotide at position nt 1703072 and nucleotide at position nt1704091. ORF6 encodes a protein having the characteristics of a GDP-D-mannose dehydratase (SEQ ID NO: 748).

The location of ORF7 is comprised between nucleotide at position nt 1704091 and nucleotide at position nt1705056. ORF7 encodes a protein having the characteristics of a nucleotide sugar epimerase involved in colanic acid biosynthesis (SEQ ID NO: 749).

The location of ORF8 is comprised between nucleotide at position nt 1705056 and nucleotide at position nt1705784 (SEQ ID NO: 750).

The location of ORF9 is comprised between nucleotide at position nt 1705808 and nucleotide at position nt1706593. ORF9 encodes a protein having the characteristics of colanic acid biosynthesis glycosyl transferase (SEQ ID NO: 751).

The location of ORF10 is comprised between nucleotide at position nt 1706631 and nucleotide at position nt 1707524 (SEQ ID NO: 752).

The location of ORF11 is comprised between nucleotide at position nt 1707530 and nucleotide at position nt 1708648. ORF11 encodes a protein similar to a spore coat polysaccharide biosynthesis (SEQ ID NO: 753).

A polynucleotide of interest obtained by the above-disclosed method according to the invention may also contain at least one ORF that encodes all or part of acidic, glycine-rich proteins, belonging to the PE and PPE families, whose genes are often clustered and based on multiple copies of the polymorphic repetitive sequences. The names PE and PPE derive from the fact that the motifs ProGlu (PE, positions 8, 9) and ProProGlu (PPE, positions 7 to 9) are found near the N-terminus in almost all cases. The PE protein family all have a highly conserved N-terminal domain of ~110 amino acid residues, that is predicted to have a globular structure, followed by a C-terminal segment which varies in size, sequence and repeat copy number. Phylogenetic analysis separated the PE family into several groups, the larger of which is the highly repetitive PGRS class containing 55 members whereas the other groups share very limited sequence similarity in their C-terminal domains. The predicted molecular weights of the PE proteins vary considerably as a few members only contain the ~110 amino acid N-terminal domain while the majority have C-terminal extensions ranging in size from 100 up to >1400 residues. A striking feature of the PGRS proteins is their exceptional glycine content (up to 50%) due to the presence of multiple tandem repetitions of GlyGlyAla or GlyGlyAsn motifs or variations thereof.

Like the PE family, the PPE protein family also has a conserved N-terminal domain that comprises ~180 amino acid residues followed by C-terminal segments that vary considerably in sequence and length. These proteins fall into at least three groups, one of which constitutes the MPTR class characterised by the presence of multiple, tandem copies of the motif AsnXGlyXGlyAsnXGly (SEQ ID NO. 730). The second subgroup contains a characteristic, well-conserved motif around position 350 (GlyXXSerValProXXTrp)(SEQ ID NO. 731), whereas the other group contains proteins that are unrelated except for the presence of the common 180-residue PPE domain. C-terminal extensions may range in size from 00 up to 3500 residues.

One member of the PGRS sub-family, the WHO antigen 22T (Abou-Zeid et al., 1991), a 55 kD protein capable of binding fibronectin, is produced during disease and elicits a variable antibody response suggesting either that individuals mount different immune responses or that this PGRS-protein may not be produced in this form by all strains of *M. tuberculosis*. In other words, at least some PE_PGRS coding sequences encode for proteins that are involved in the recognition of *M. tuberculosis* by the immune system of the infected host. Therefore, differences in the PGRS sequences could represent the principal source of antigenic variation in the otherwise genetically and antigenically homogeneous bacterium.

By performing the method of the invention using the *M. tuberculosis* BAC based DNA library I-1945, the inventors have discovered the occurrence of sequence differences between a given PGRS encoding ORF (ORF reference on the genomic sequence of *M. tuberculosis* Rv0746) of *M. tuberculosis* and its counterpart sequence in the genome of *M. bovis* BCG.

More precisely, the inventors have determined that one ORF contained in BAC vector No Rv418 of the *M. tuberculosis* BCG I-1945 DNA library carries both base additions and base deletions when compared with the corresponding ORF in the genome of *M. bovis* BCG that is contained in the BAC vector No X0175 of the *M. bovis* BCG I-2049 DNA library. The variations observed in the base sequences correspond to variations in the C-terminal part of the amino acid sequence of the PGRS ORF translation product.

As shown in FIG. 6, an amino acid stretch of 9 residues in length is present in this *M. tuberculosis* PGRS (ORf reference Rv0746) and is absent from the ORF counterpart of *M. bovis* BCG, namely the following amino acid sequence:

(SEQ ID NO. 732)
$NH_2$-GGAGGAGGSSAGGGGAGGAGGAGGWLL
GD-COOH.

Furthermore, FIG. 6 shows also that an amino acid stretch of 45 residues in length is absent from this *M. tuberculosis* PGRS and is present in the ORF counterpart of *M. bovis* BCG, namely following amino acid sequence:

(SEQ ID NO. 733)
$NH_2$-GAGGIGGIGGNANGGAGGNGGTGGQLWGSGGAGVEGGAAL
SVGDT-COOH.

Similar observations were made with PPE ORF Rv0442, which showed a 5 codon deletion relative to a *M. bovis* amino acid sequence.

Given that the polymorphism associated with the PE-PGRS or PEE ORFS resulted in extensive antigenic variability or reduced antigen presentation, this would be of immense significance for vaccine design, for understanding protective immunity in tuberculosis and, possibly, explain the varied responses seen in different BCG vaccination programmes.

There are several striking parallels between the PGRS proteins and the Epstein-Barr virus-encoded nuclear antigens (EBNA). Both polypeptide families are glycine-rich, contain Gly-Ala repeats that represent more than one third of the molecule, and display variation in the length of the repeat region between different isolates. The Gly-Ala repeat region of EBNA1 has been shown to function as a cis-acting inhibitor of antigen processing and MHC class I-restricted antigen presentation. (Levitskaya et al., 1995). The fact that MHC class I knock-out mice are extremely susceptible to *M. tuber-*

*culosis* underlines the importance of MHC class I antigen presentation in protection against tuberculosis. Therefore, it is possible that the PE/PPE protein family also play some role in inhibiting antigen presentation, allowing the bacillus to hide from the host's immune system.

As such the novel and nonobvious PGRS polynucleotide from *M. bovis* which is homolog to the *M. tuberculosis* ORF Rv0746, and which is contained in the BAC clone No X0175 (See Table 4 for SP6 and T7 end-sequences of clone no X0175) of the I-2049 *M. bovis* BCG BAC DNA library is part of the present invention, as it represents a starting material in order to define specific probes or primers useful for detection of antigenic variability in mycobacterial strains, possible inhibition of antigen processing as well as to differentiate *M. tuberculosis* from *M. bovis* BCG.

Thus, a further object of the invention consists in a polynucleotide comprising the sequence SEQ ID No 4.

Polynucleotides of interest have been defined by the inventors as useful detection tools in order to differentiate *M. tuberculosis* from *M. bovis* BCG. Such polynucleotides are contained in the 45 amino acid length coding sequence that is present in *M. bovis* BCG but absent from *M. tuberculosis*. This polynucleotide has a sequence beginning (5' end) at the nucleotide at position nt 729 of the sequence SEQ ID No 4 and ending (3' end) at the nucleotide in position nt 863 of the sequence SEQ ID No 4.

Thus, part of the present invention is also a polynucleotide which is chosen among the following group of polynucleotides:

a) a polynucleotide comprising at least 8 consecutive nucleotides of the nucleotide sequence SEQ ID No 5;

b) a polynucleotide which sequence is fully complementary to the sequence of the polynucleotide defined in a);

c) a polynucleotide that hybridizes under stringent hybridization conditions with the polynucleotide defined in a) or with the polynucleotide defined in b).

The stringent hybridization conditions for the purpose of defining the above disclosed polynucleotide are defined herein before in the specification.

The invention also provides for a BAC-based *Mycobacterium tuberculosis* strain H37Rv genomic DNA library that has been deposited in the Collection Nationale de Cultures de Microorganismes on Nov. 19, 1997 under the accession number I-1945.

A further object of the invention consists in a recombinant BAC vector which is chosen among the group consisting of the recombinant BAC vectors belonging to the BAC-based DNA library I-1945.

Generally, a recombinant BAC vector of interest may be chosen among the following set or group of BAC vectors contained in the BAC-based DNA library I-1945:

Rv101; Rv102; Rv103; Rv104; Rv105; Rv106; Rv107; Rv108; Rv109; Rv10; Rv110; Rv111; Rv112; Rv113; Rv114; Rv115; Rv116; Rv117; Rv118; Rv119; Rv11; Rv120; Rv121; Rv122; Rv123; Rv124; Rv126; Rv127; Rv128; Rv129; Rv130; Rv132; Rv134; Rv135; Rv136; Rv137; Rv138; Rv139; Rv13; Rv140; Rv141; Rv142; Rv143; Rv144; Rv145; Rv146; Rv147; Rv148; Rv149; Rv14; Rv150; Rv151; Rv152; Rv153; Rv154; Rv155; Rv156; Rv157; Rv159; Rv15; Rv160; Rv161; Rv162; Rv163; Rv164; Rv165; Rv166; Rv167; Rv169; Rv16; Rv170; Rv171; Rv172; Rv173; Rv174; Rv175; Rv176; Rv177; Rv178; Rv179; Rv17; Rv180; Rv181; Rv182; Rv183; Rv184; Rv185; Rv186; Rv187; Rv188; Rv18; Rv190; Rv191; Rv192; Rv193; Rv194; Rv195; Rv196; Rv19; Rv1; Rv201; Rv204; Rv205; Rv207; Rv209; Rv20; Rv214; Rv215; Rv217; Rv218; Rv219; Rv21; Rv220; Rv221; Rv222; Rv223; Rv224; Rv225; Rv226; Rv227; Rv228; Rv229; Rv22; Rv230; Rv231; Rv232; Rv233; Rv234; Rv235; Rv237; Rv240; Rv241; Rv243; Rv244; Rv245; Rv246; Rv247; Rv249; Rv24; Rv251; Rv252; Rv253; Rv254; Rv255; Rv257; Rv258; Rv259; Rv25; Rv260; Rv261; Rv262; Rv263; Rv264; Rv265; Rv266; Rv267; Rv268; Rv269; Rv26; Rv270; Rv271; Rv272; Rv273; Rv274; Rv275; Rv276; Rv277; Rv278; Rv279; Rv27; Rv280; Rv281; Rv282; Rv283; Rv284; Rv285; Rv286; Rv287; Rv288; Rv289; Rv28; Rv290; Rv291; Rv292; Rv293; Rv294; Rv295; Rv296; Rv29; Rv2; Rv301; Rv302; Rv303; Rv304; Rv306; Rv307; Rv308; Rv309; Rv30; Rv310; Rv31; Rv312; Rv313; Rv314; Rv315; Rv316; Rv317; Rv318; Rv319; Rv31; Rv32; Rv322; Rv327; Rv328; Rv329; Rv32; Rv330; Rv331; Rv333; Rv334; Rv335; Rv336; Rv337; Rv338; Rv339; Rv33; Rv340; Rv341; Rv343; Rv344; Rv346; Rv347; Rv348; Rv349; Rv34; Rv350; Rv351; Rv352; Rv353; Rv354; Rv355; Rv356; Rv357; Rv358; Rv359; Rv35; Rv360; Rv361; Rv363; Rv364; Rv365; Rv366; Rv367; Rv368; Rv369; Rv36; Rv370; Rv371; Rv373; Rv374; Rv375; Rv376; Rv377; Rv378; Rv379; Rv37; Rv381; Rv382; Rv383; Rv384; Rv385; Rv386; Rv387; Rv388; Rv389; Rv38; Rv390; Rv391; Rv392; Rv393; Rv396; Rv39; Rv3; Rv40; Rv412; Rv413; Rv414; Rv415; Rv416; Rv417; Rv418; Rv419; Rv41; Rv42; Rv43; Rv44; Rv45; Rv46; Rv47; Rv48; Rv49; Rv4; Rv50; Rv51; Rv52; Rv53; Rv54; Rv55; Rv56; Rv57; Rv58; Rv59; Rv5; Rv60; Rv61; Rv62; Rv63; Rv64; Rv65; Rv66; Rv67; Rv68; Rv69; Rv6; Rv70; Rv71; Rv72; Rv73; Rv74; Rv75; Rv76; Rv77; Rv78; Rv79; Rv7; Rv80; Rv81; Rv82; Rv83; Rv84; Rv85; Rv86; Rv87; Rv88; Rv89; Rv8; Rv90; Rv91; Rv92; Rv94; Rv95; Rv96; Rv9.

The end sequences of the polynucleotide inserts of each of the above clones corresponding respectively to the sequences adjacent to the T7 promoter and to the Sp6 promoter on the BAC vector are shown in Table 3.

It has been shown by the inventors that the minimal overlapping set of BAC vectors of the BAC-based DNA library I-1945 contains 68 unique BAC clones and practically spans almost the whole H37Rv chromosome with the exception of a single gap of approximately 150 kb.

More specifically, a recombinant BAC vector of interest is chosen among the following set or group of BAC vectors from the BAC-based DNA library I-1945, the location of which vector DNA inserts on the chromosome of *M. tuberculosis* is shown in FIG. 3:

Rv234; Rv351; Rv166; Rv35; Rv415; Rv404; Rv209; Rv272; Rv30; Rv228; Rv233; Rv38; Rv280; Rv177; Rv48; Rv374; Rv151; Rv238; Rv156; Rv92; Rv3; Rv403; Rv322; Rv243; Rv330; Rv285; Rv233; Rv219; Rv416; Rv67; Rv222; Rv149; Rv279; Rv87; Rv273; Rv266; Rv25; Rv136; Rv414; Rv13; Rv289; Rv60; Rv104; Rv5; Rv165; Rv215; Rv329; Rv240; Rv19; Rv74; Rv411; Rv167; Rv56; Rv80; Rv164; Rv59; Rv313; Rv265; Rv308; Rv220; Rv258; Rv339; Rv121; Rv419; Rv418; Rv45; Rv217; Rv134; Rv17; Rv103; Rv21; Rv22; Rv2; Rv270; Rv267; Rv174; Rv257; Rv44; Rv71; Rv7; Rv27; Rv191; Rv230; Rv128; Rv407; Rv106; Rv39; Rv255; Rv74; Rv355; Rv268; Rv58; Rv173; Rv264; Rv417; Rv401; Rv144; Rv302; Rv81; Rv163; Rv281; Rv221; Rv420; Rv175; Rv86; Rv412; Rv73; Rv269; Rv214; Rv287; Rv42; Rv143.

The polynucleotides disclosed in Table 3 may be used as probes in order to select a given clone of the BAC DNA library I-1945 for further use.

The invention also provides for a BAC-based *Mycobacterium bovis* strain Pasteur genomic DNA library that has been deposited in the Collection Nationale de Cultures de Microorganismes on Jun. 30, 1998 under the accession number I-2049.

A further object of the invention consists in a recombinant BAC vector which is chosen among the group consisting of the recombinant BAC vectors belonging to the BAC-based DNA library I-2049. This DNA library contains approximately 1600 clones. The average insert size is estimated to be ~80 kb.

Generally, a recombinant BAC vector of interest may be chosen among the following set or group of BAC vectors contained in the BAC-based DNA library I-2049:

X000; X0002; X0003; X0004; X0006; X0007; X0008; X0009; X0010; X0012; X0013; X0014; X0015; X0016; X0017; X0018; X0019; X0020; X0021; X0175.

The end sequences of the polynucleotide inserts of each of the above clones corresponding respectively to the sequences adjacent to the T7 promoter and to the Sp6 promoter on the BAC vector are shown in Table 4.

The polynucleotides disclosed in Table 4 may be used as probes in order to select a given clone of the BAC DNA library I-2049 for further use.

Are also part of the invention the polynucleotide inserts that are contained in the above described BAC vectors, that are useful as primers or probes.

These polynucleotides and nucleic acid fragments may be used as primers for use in amplification reactions, or as nucleic probes.

PCR is described in the U.S. Pat. No. 4,683,202. The amplified fragments may be identified by an agarose or a polyacrylamide gel electrophoresis, or by a capillary electrophoresis or alternatively by a chromatography technique (gel filtration, hydrophobic chromatography or ion exchange chromatography). The specificity of the amplification may be ensured by a molecular hybridization using, for example, one of the initial primers as nucleic probes.

Amplified nucleotide fragments are used as probes in hybridization reactions in order to detect the presence of one polynucleotide according to the present invention or in order to detect mutations in the genome of the given mycobacterium of interest, specifically a mycobacterium belonging to the *Mycobacterium tuberculosis* complex and more specifically *Mycobacterium tuberculosis* and *Mycobacterium bovis* BCG.

Are also part of the present invention the amplified nucleic fragments (<<amplicons>>) defined herein above.

These probes and amplicons may be radioactively or non-radioactively labeled, using for example enzymes or fluorescent compounds.

Other techniques related to nucleic acid amplification may also be used and are generally preferred to the PCR technique.

The Strand Displacement Amplification (SDA) technique (Walker et al., 1992) is an isothermal amplification technique based on the ability of a restriction enzyme to cleave one of the strands at his recognition site (which is under a hemiphosphorothioate form) and on the property of a DNA polymerase to initiate the synthesis of a new strand from the 3'OH end generated by the restriction enzyme and on the property of this DNA polymerase to displace the previously synthesized strand being localized downstream. The SDA method comprises two main steps:

a) The synthesis, in the presence of dCTP-alpha-S, of DNA molecules that are flanked by the restriction sites that may be cleaved by an appropriate enzyme.

b) The exponential amplification of these DNA molecules modified as such, by enzyme cleavage, strand displacement and copying of the displaced strands. The steps of cleavage, strand displacement and copy are repeated a sufficient number of times in order to obtain an accurate sensitivity of the assay.

The SDA technique was initially realized using the restriction endonuclease HindIII but is now generally practised with an endonuclease from *Bacillus stearothermophilus* (BSOBI) and a fragment of a DNA polymerase which is devoid of any 5'→3'exonuclease activity isolated from *Bacillus cladotenax* (exo−Bca)[=exo−minus−Bca]. Both enzymes are able to operate at 60° C. and the system is now optimized in order to allow the use of dUTP and the decontamination by UDG. When using this technique, as described by Spargo et al. in 1996, the doubling time of the target DNA is of 26 seconds and the amplification rate is of $10^{10}$ after an incubation time of 15 min at 60° C.

The SDA amplification technique is more easy to perform than PCR (a single thermostated waterbath device is necessary) and is faster than the other amplification methods.

Thus, another object of the present invention consists in using the nucleic acid fragments according to the invention (primers) in a method of DNA or RNA amplification according to the SDA technique. For performing SDA, two pairs of primers are used: a pair of external primers (B1, B2) consisting of a sequence specific for the target polynucleotide of interest and a pair of internal primers (S1, S2) consisting of a fusion oligonucleotide carrying a site that is recognized by a restriction endonuclease, for example the enzyme BSOBI.

The operating conditions to perform SDA with such primers are described in Spargo et al, 1996.

The polynucleotides of the invention and their above described fragments, especially the primers according to the invention, are useful as technical means for performing different target nucleic acid amplification methods such as:

TAS (Transcription-based Amplification System), described by Kwoh et al. in 1989.

SR (Self-Sustained Sequence Replication), described by Guatelli et al. in 1990.

NASBA (Nucleic acid Sequence Based Amplification), described by Kievitis et al. in 1991.

TMA (Transcription Mediated Amplification).

The polynucleotides according to the invention are also useful as technical means for performing methods for amplification or modification of a nucleic acid used as a probe, such as:

LCR (Ligase Chain Reaction), described by Landegren et al. in 1988 and improved by Barany et al. in 1991 who employ a thermostable ligase.

RCR (Repair Chain Reaction) described by Segev et al. in 1992.

CPR (Cycling Probe Reaction), described by Duck et al. in 1990.

Q-beta replicase reaction, described by Miele et al. in 1983 and improved by Chu et al. in 1986, Lizardi et al. in 1988 and by Burg et al. and Stone et al. in 1996.

When the target polynucleotide to be detected is a RNA, for example a mRNA, a reverse transcriptase enzyme will be used before the amplification reaction in order to obtain a cDNA from the RNA contained in the biological sample. The generated cDNA is subsequently used as the nucleic acid target for the primers or the probes used in an amplification process or a detection process according to the present invention.

The non-labeled polynucleotides or oligonucleotides of the invention may be directly used as probes. Nevertheless, the polynucleotides or oligonucleotides are generally labeled with a radioactive element $^{32}P$, $^{35}S$, $^{3}H$, $^{125}I$) or by a nonisotopic molecule (for example, biotin, acetylaminofluorene, digoxigenin, 5bromodesoxyuridin, fluorescein) in order to generate probes that are useful for numerous applications.

Examples of non-radioactive labeling, of nucleic acid-fragments are described in the french patent No FR-7810975 or by Urdea et al. or Sanchez-Pescador et al., 1988.

In the latter case, other labeling techniques may be also used such as those described in the french patents FR-2 422 956 and 2 518 755. The hybridization step may be performed in different ways (Matthews et al., 1988). The more general method consists of immobilizing the nucleic acid that has been extracted from the biological sample onto a substrate (nitrocellulose, nylon, polystyrene) and then to incubate, in defined conditions, the target nucleic acid with the probe. Subsequently to the hybridization step, the excess amount of the specific probe is discarded and the hybrid molecules formed are detected by an appropriate method (radioactivity, fluorescence or enzyme activity measurement).

Advantageously, the probes according to the present invention may have structural characteristics such that they allow the signal amplification, such structural characteristics being, for example, branched DNA probes as those described by Urdea et al. in 1991 or in the European patent No EP-0 225 807 (Chiron).

In another advantageous embodiment of the probes according to the present invention, the latters may be used as <<capture probes>>, and are for this purpose immobilized on a substrate in order to capture the target nucleic acid contained in a biological sample. The captured target nucleic acid is subsequently detected with a second probe which recognizes a sequence of the target nucleic acid which is different from the sequence recognized by the capture probe.

The oligonucleotide probes according to the present invention may also be used in a detection device comprising a matrix library of probes immobilized on a substrate, the sequence of each probe of a given length being localized in a shift of one or several bases, one from the other, each probe of the matrix library thus being complementary to a distinct sequence of the target nucleic acid. Optionally, the substrate of the matrix may be a material able to act as an electron donor, the detection of the matrix positions in which an hybridization has occurred being subsequently determined by an electronic device. Such matrix libraries of probes and methods of specific detection of a target nucleic acid is described in the European patent application No EP-0 713 016 (Affymax technologies) and also in the U.S. Pat. No. 5,202,231 (Drmanac).

Since almost the whole length of a mycobacterial chromosome is covered by a BAC-based genomic DNA libraries according to the present invention (i.e. 97% of the *M. tuberculosis* chromosome is covered by the BAC library I-1945), these DNA libraries will play an important role in a plurality of post-genomic applications, such as in mycobacterial gene expression studies where the canonical set of BACs could be used as a matrix for hybridization studies. Probing such matrices with cDNA probes prepared from total mRNA will uncover genetic loci induced or repressed under different physiological conditions (Chuang et al., 1993; Trieselmann et al., 1992). As such, the H37Rv BAC library represents a fundamental resource for present and future genomics investigations.

The BAC vectors or the polynucleotide inserts contained therein may be directly used as probes, for example when immobilized on a substrate such as described herein before.

The BAC vectors or their polynucleotide inserts may be directly absorbed on a nitrocellulose membrane, at predetermined locations on which one or several polynucleotides to be tested are then put to hybridize therewith.

Preferably, a collection of BAC vectors that spans the whole genome of the mycobacterium under testing will be immobilized, such as, for example, the set of 68 BAC vectors of the I-1945 DNA library that is described elsewhere in the specification and shown in FIG. 3.

The immobilization and hybridization steps may be performed as described in the present Materials and Methods Section.

As another illustrative embodiment of the use of the BAC vectors of the invention as polynucleotide probes, these vectors may be useful to perform a transcriptional activity analysis of mycobacteria growing in different environmental conditions, for example under conditions in which a stress response is expected, as it is the case at an elevated temperature, for example 40° C.

In this specific embodiment of the invention, Genescreen membranes may be used to immobilize the restriction endonuclease digests (HindIII digests for the BAC DNA library I-1945) of the BAC vectors by transfer from a gel (Trieselmann et al., 1992).

Alternatively, the BAC vectors may be immobilized for dot blot experiments as follows. First, the DNA concentration of each BAC clone is determined by hybridization of blots of clone DNAs and of a BAC vector concentration standard with a BAC vector specific DNA probe. Hybridization is quantified by the Betascope 603 blot analyzer (Betagen Corp.), which collects beta particles directly from the blot with high efficiency. Then, 0.5 μg of each clone DNA is incubated in 0.25 M NaOH and 10 mM EDTA at 65° C. for 60 min to denature the DNA and degrade residual RNA contaminants. By using a manifold filtration system (21 by 21 wells), each clone DNA is blotted onto a GeneScreen Plus nylon membrane in the alkaline solution. After neutralization, the blots are baked at 85° C. for 2 h under vacuum. Positive and negative controls are added when necessary. In order to perform this procedure, it may be refer-red to the article of Chuang et al. (1993).

For RNA extractions, cells grown in a suitable volume of culture medium may, for example, be immediately mixed with an equal volume of crushed ice at −70° C. and spun at 4° C. in a 50 ml centrifugation tube. The cell pellet is then suspended in 0.6 ml of ice-cold buffer (10 mM KCl, 5 mM MgCl, 10 mM Tris; pH 7.4) and then immediately added to 0.6 ml of hot lysis buffer (0.4 M NaCl, 40 mM EDTA, 1% beta-mercaptoethanol, 1% SDS, 20 mM Tris; pH 7.4) containing 100 μl of water saturated phenol. This mixture is incubated in a boiling water bath for 40 s. The debris are removed by centrifugation. The supernatant is extracted with phenol-chloroform five times, ethanol precipitated, and dried. The dried RNA pellet is dissolved in water before use.

Then labeled total cDNA may be prepared by the following method. The reaction mixture contains 15 μg of the previously prepared total RNA, 5 μg of pd($N_6$) (random hexamers from Pharmacia Inc.), 0.5 mM dATP, 0.5 mM dGTP and 0.5 mM DTTP, 5 μM dCTP, 100 μCi of [$\alpha$-$^{32}$P]dCTP (3,000 Ci/mmol), 50 mM Tris-HCl (pH 8.3), 6 mM $MgCl_2$, 40 mM Kcl, 0.5 U of avian myeloblastosis virus reverse transcriptase (Life Science Inc.) in a total volume of 50 μl. The reaction is allowed to continue overnight at room temperature. EDTA and NaOH are then added to final concentrations of 50 mM and 0.25 M, respectively, and the mixture is incubated at 65° C. for 30 min to degrade the RNA templates. The cDNA is then ready to use after neutralization by adding Hcl and Tris buffer.

The hybridization step may be performed as described by Chuang et al. (1993) and briefly disclosed hereinafter. The DNA dot blot is hybridized to $^{32}$P-labeled total cDNA in a solution containing 0.1% polyvinylpyrrolidone, 0.1% Ficoll 0.1% sodium Ppi, 0.1% bovine serum albumin, 0.5% SDS, 100 mM NaCl, and 0.1 mM sodium citrate, pH 7.2, at 65° C. for 2 days and then washed with a solution containing 0.1% SDS, 100 mM NaCl, and 10 mM Na-citrate, pH 7.2. The same dot blot is used for hybridization with both control and experimental cDNAs, with an alkaline probe stripping procedure (soaked twice in 0.25M NaOH-0.75 M NaCl at room temperature, 30 min each, neutralized, and completely dried at 65° C. for at least 30 min) between the two hybridizations. Quantification may be done with the Betascope 603 blot analyzer (Betagen Corp.).

As it flows from the above technical teachings, another object of the invention consists in a method for detecting the presence of mycobacteria in a biological sample comprising the steps of:

a) bringing into contact the recombinant BAC vector or a purified polynucleotide according to the invention with a biological sample;

b) detecting the hybrid nucleic acid molecule formed between said purified polynucleotide and the nucleic acid molecules contained within the biological sample.

The invention further deals with a method for detecting the presence of mycobacteria in a biological sample comprising the steps of:

a) bringing into contact the recombinant BAC vector or a purified polynucleotide according to the invention that has been immobilized onto a substrate with a biological sample;

b) bringing into contact the hybrid nucleic acid molecule formed between said purified polynucleotide and the nucleic acid contained in the biological sample with a labeled recombinant BAC vector or a polynucleotide according to the invention, provided that said polynucleotide and polynucleotide of step a) have non-overlapping sequences.

Another object of the invention consists in a method for detecting the presence of mycobacteria in a biological sample comprising the steps of:

a) bringing into contact the nucleic acid molecules contained in the biological sample with a pair of primers according to the invention;

b) amplifying said nucleic acid molecules;

c) detecting the nucleic acid fragments that have been amplified, for example by gel electrophoresis or with a labeled polynucleotide according to the invention.

In one specific embodiment of the above detection and/or amplification methods, said methods comprise an additional step wherein before step a), the nucleic acid molecules of the biological sample have been made available to a hybridization reaction.

In another specific embodiment of the above detection methods, said methods comprise an additional step, wherein, before the detection step, the nucleic acid molecules that are not hybridized with the immobilized purified polynucleotide are removed.

Also part of the invention is a kit for detecting mycobacteria in a biological sample comprising:

a) a recombinant BAC vector or a purified polynucleotide according to the invention;

b) reagents necessary to perform a nucleic acid hybridization reaction.

The invention also pertains to a kit for detecting a mycobacteria in a biological sample comprising:

a) a recombinant BAC vector or a purified polynucleotide according to the invention that is immobilized onto a substrate;

b) reagents necessary to perform a nucleic acid hybridization reaction;

c) a purified polynucleotide according to the invention which is radioactively or non-radioactively labeled, provided that said polynucleotide and the polynucleotide of step a) have non-overlapping sequences.

Moreover, the invention provides for a kit for detecting mycobacteria in a biological sample comprising:

a) a pair of purified primers according to the invention;

b) reagents necessary to perform a nucleic acid amplification reaction;

c) optionally, a purified polynucleotide according to the invention useful as a probe.

The invention embraces also a method for detecting the presence of a genomic DNA, a cDNA or a mRNA of mycobacteria in a biological sample, comprising the steps of:

a) bringing into contact the biological sample with a plurality of BAC vectors according to the invention or purified polynucleotides according to the invention, that are immobilized on a substrate;

b) detecting the hybrid complexes formed.

The invention also provides a kit for detecting the presence of genomic DNA, cDNA or mRNA of a mycobacterium in a biological sample, comprising:

a) a substrate on which a plurality of BAC vectors according to the invention or purified polynucleotides according to the invention have been immobilized;

b) optionally, the reagents necessary to perform the hybridization reaction.

Additionally, the recombinant BAC vectors according to the invention and the polynucleotide inserts contained therein may be used for performing detection methods based on <<molecular combing>>. Said methods consist in methods for aligning macromolecules, especially DNA and are applied to processes for detecting, for measuring intramolecular distance, for separating and/or for assaying a macromolecule, especially DNA in a sample.

These <<molecular combing>> methods are simple methods, where the triple line S/A/B (meniscus) resulting form the contact between a solvent A and the surface S and a medium B is caused to move on the said surface S, the said macromolecules (i.e. DNA) having a part, especially an end, anchored on the surface S, the other part, especially the other end, being in solution in the solvent A. These methods are particularly fully described in the PCT Application no PCT/FR 95/00165 files on Feb. 11, 1994 (Bensimon et al.).

When performing the <<molecular combing>> method with the recombinant BAC vectors according to the inventions or their polynucleotide inserts, the latters may be immobilized (<<anchored>>) on a suitable substrate and aligned as described in the PCT Application no PCT/FR 95/00165, the whole teachings of this PCT Application being herein incorporated by reference. Then, polynucleotides to be tested, preferably under the form of radioactively or non radioactively labeled polynucleotides, that may consist of fragments of genomic DNA, cDNA etc. are brought into contact with the previously aligned polynucleotides according to the present invention and then their hybridization position on the aligned DNA molecules is determined using any suitable means including a microscope or a suitable camera device.

Thus, the present invention is also directed to a method for the detection of the presence of a polynucleotide of mycobacterial origin in a biological sample and/or for physical mapping of a polynucleotide on a genomic DNA, said method comprising:

a) aligning at least one polynucleotide contained in a recombinant BAC vector according to the invention on the surface of a substrate;

b) bringing into contact at least one polynucleotide to be tested with the substrate on which the at least one polynucleotide of step a) has been aligned;

c) detecting the presence and/or the location of the tested polynucleotide on the at least one aligned polynucleotide of step a).

The invention finally provides for a kit for performing the above method, comprising:

a) a substrate whose surface has at least one polynucleotide contained in a recombinant BAC vector according to the invention;

b) optionally, reagents necessary for labeling DNA;

c) optionally, reagents necessary for performing a hybridization reaction.

In conclusion, it may be underlined that the alliance of such BAC-based approaches such as described in the present specification to the advances in comparative genomics by the availability of an increased number of complete genomes, and the rapid increase of well-characterized gene products in the public databases, will allow the one skilled in the art an exhaustive analysis of the mycobacterial genome.

Materials and Methods

1. DNA-preparation. Preparation of *M. tuberculosis* H37Rv DNA in agarose plugs was conducted as previously described (Canard et al., 1989; Philipp et al., 1996b). Plugs were stored in 0.2 M EDTA at 4° C. and washed 3 times in 0.1% Triton X-100 buffer prior to use.

2. BAC vector preparation. pBeloBAC11 was kindly provided by Dr. Shizuya, Department of Biology, California Institute of Technology (Pasadena, Calif.). The preparation followed the description of Woo et al., 1994 (Woo et al., 1994).

3. Partial digestion with HindIII. Partial digestion was carried out on plugs, each containing approximately 10 μg of high molecular weight DNA, after three one hour equilibration steps in 50 ml of HindIII 1× digestion buffer (Boehringer Mannheim, Mannheim, Germany) plus 0.1% Triton X-100. The buffer was then removed and replaced by 1 ml/plug of ice-cold HindIII enzyme buffer containing 20 units of HindIII (Boehringer). After two hours incubation on ice, the plugs were transferred to a 37° C. water bath for 30 minutes. Digestions were stopped by adding 500 μl of 50 mM EDTA (pH 8.0).

4. Size selection. The partially digested DNA was subjected to contour-clamped homogenous electric field (CHEF) electrophoresis on a 1% agarose gel using a BioRad DR III apparatus (BioRad, Hercules, Calif.) in IX TAE buffer at 13° C., with a ramp from 3 to 15 seconds at 6 V/cm for 16 hours. Agarose slices from 25 to 75 kb, 75 to 120 kb and 120 to 180 kb were excised from the gel and stored in TE at 4° C.

5. Ligation and transformation. Agarose-slices containing fractions from 25 to 75 kb, 75 to 120 kb and 120 to 180 kb were melted at 65° C. for 10 minutes and digested with Gelase (Epicentre Technologies, Madison, Wis.), using 1 unit per 100 μl gel-slice. 25-100 ng of the size-selected DNA was then ligated to 10 ng of HindIII digested, dephosphorylated pBeloBAC11 in a 1:10 molar ratio using 10 units of T4 DNA ligase (New England Biolabs, Beverly, Mass.) at 16° C. for 20 hours. Ligation mixtures were heated at 65° C. for 15 minutes, then drop-dialysed against TE using Millipore VS 0.025 mM membranes (Millipore, Bedford, Mass.). Fresh electrocompetent *E. coli* DH10B cells (Sheng et al., 1995) were harvested from 200 ml of a mid-log ($OD_{550}$=0.5) culture grown in SOB medium. Cells were washed three times in ice-cold water, and finally resuspended in ice-cold water to a cell density of $10^{11}$ cells/ml ($OD_{550}$=150). 1 μl of the ligation-mix was used for electroporation of 30 μl of electrocompetent DH1OB *E. coli* using a Eurogentec Easyject Plus electroporator (Eurogentec, Seraing, Belgium), with settings of 2.5 kV, 25 μF, and 99Ω, in 2 mm wide electroporation cuvettes. After electroporation, cells were resuspended in 600 μl of SOC medium, allowed to recover for 45 minutes at 37° C. with gentle shaking, and then plated on LB agar containing 12.5 μg/ml chloramphenicol (CM), 50 μg/ml-X-gal, and 25 μg/ml IPTG. The plates were incubated overnight and recombinants (white colonies) were picked manually to 96 well plates. Each clone was inoculated 3 times (2×200 μl and 1×100 μl of 2YT/12.5 μg/ml CM per clone) and incubated overnight. One of the microtiter plates, containing 100 μl culture per well, was maintained as a master plate at −80° C. after 100 ml of 80% glycerol were added to each well, while minipreps (Sambrook et al., 1989) were prepared from the remaining two plates to check for the presence of inserts. Clones containing inserts were then designated "Rv" clones, repicked from the master plate to a second set of plates for storage of the library at −80° C.

6. Preparation of DNA for sizing, direct sequencing and comparative genomics. A modified Birnboim and Doly protocol (Birnboim et al., 1979) was used for extraction of plasmid DNA for sequencing purposes. Each Rv clone was inoculated into a 50 ml Falcon polypropylene tube containing 40 ml of 2YT medium with 12.5 μg/ml of CM and grown overnight at 37° C. with shaking. Cells were harvested by centrifugation and stored at −20° C. The frozen pellet was resuspended in 4 ml of Solution A (50 mM glucose, 10 mM EDTA, 25 mM Tris, pH 8.0) and 4 ml of freshly prepared solution B (0.2 M NaOH 0.2% SDS) was then added. The solution was gently mixed and kept at room temperature for 5 minutes before adding 4 ml of ice-cold solution C (3M Sodium Acetate, pH 4.7). Tubes were kept on ice for 15 min, and centrifuged at 10,000 rpm for 15 min. After isopropanol precipitation, the DNA pellet was dissolved in 600 μl RNase solution (15 mM Tris HCl pH 8.0, 10 μg/ml RNase A). After 30 minutes at 37° C. the DNA solution was extracted with chloroform:isoamylalcohol (24:1) and precipitated from the aqueous phase using isopropanol. The DNA pellet was then rinsed with 70% ethanol, air-dried and dissolved in 30 μl distilled water. In general, DNA prepared by this method was clean and concentrated enough to give good quality results by automatic sequencing (at least 300 bp of sequence). For a few DNA preparations, an additional polyethylene glycol (PEG) precipitation step was necessary, which was performed as follows. The 30 μl of DNA solution were diluted to 64 μl, mixed gently and precipitated using 16 μl 4M NaCl and 80 μl of 13% PEG 8000. After 30 min on ice the tubes were centrifuged at 4° C., the pellet carefully rinsed with 70% ethanol, air-dried and diluted in 20 μl of distilled water.

7. Sizing of inserts. Insert sizes were determined by pulsed-field gel electrophoresis (PFGE) after cleavage with DraI (Promega). 100-200 ng of DNA was DraI-cleaved in 20 μl total reaction volume, following the manufacturer's recommendations, then loaded onto a 1% agarose gel and migrated using a pulse of 4 s for 15 h at 6.25 V/cm at 10° C. on an LKB-Pharmacia CHEF apparatus. Mid-range and low-range PFGE markers (New England Biolabs) were used as size standards. Insert sizes were estimated after ethidium bromide staining of gels.

8. Direct sequencing. For each sequencing reaction 7 μl BAC DNA (300-500 ng), 2 μl primer (2 μM), 8 μl reaction mix of the Taq DyeDeoxy Terminator cycle sequencing kit (Applied Biosystems) and 3 μl distilled water were used.

After 26 cycles (96° C. for 30 sec; 56° C. for 15 sec; 60° C. for 4 min) in a thermocycler (MJ-research Inc., Watertown, Mass.) DNA was precipitated using 70 μl of 70% ethanol/0.5 mM $MgCl_2$, centrifuged, rinsed with 70% ethanol, dried and dissolved in 2 μl of formamide/EDTA buffer. SP6 and T7 samples of 32 BAC clones were loaded onto 64 lane, 6% polyacrylamide gels and electrophoresis was performed on a Model 373A automatic DNA sequencer (Applied Biosystems) for 12 to 16 hours. The sequences of oligonucleotides used as primers are shown in Table 1.

9. DOP-PCR. As an alternate procedure we used partially degenerate oligonucleotides in combination with vector-specific (SP6 or T7) primers to amplify insert ends of BAC clones, following a previously published protocol for P1 clones (Liu et al., 1995). The degenerate primers Deg2, Deg3, Deg4, Deg6 (Table 1) gave the best results for selected amplification of insert termini.

Table 1: Primers Used for PCRs and Sequencing

Vector Specific Primers for DOP PCR-First Amplification Step:

```
SP6-BAC1:
AGT TAG CTC ACT CAT TAG GCA   (SEQ ID NO. 734)

T7-BAC1:
GGA TGT GCT GCA AGG CGA TTA   (SEQ ID NO. 735)
```

Vector Specific Primers (Direct Sequencing Nested Primer for Second PCR Step)

```
SP6 Mid:
AAA CAG CTA TGA CCA TGA TTA CGC   (SEQ ID NO. 736)
CAA

T7-Belo2:
TCC TCT AGA GTC GAC CTG CAG GCA   (SEQ ID NO. 737)
```

Degenerate Primers:

```
Deg2:  TCT AGA NNN NNN TCC GGC      (SEQ ID NO. 738)

Deg3:  TCT AGA NNN NNN GGG CCC      (SEQ ID NO. 739)

Deg4:  CGT TTA AAN NNN NWA GGC CG   (SEQ ID NO. 740)

Deg6:  GGT ACT AGT NNN NNW TCC GGC  (SEQ ID NO. 741)
```

Primers Used for the Amplification of *M. bovis* DNA in Polymorphic Chromosomal Region of Rv58:

```
Primer 1:
AGG ACC TCA TAT TCC GAA TCC C     (SEQ ID NO. 742)

Primer 2:
GCA TCT GTT GAG TAC GCA CTT CC    (SEQ ID NO. 743)
```

10. Screening by pooled PCR. To identify particular clones in the library which could not be detected by random end-sequencing of the 400 BAC clones, PCR-screening of DNA pools was performed. Primers were designed for regions of the chromosome where no BAC coverage was apparent using cosmid- or H37Rv whole genome shotgun sequences. Primers were designed to amplify approximately 400-500 bp. Ninety-six-well plates containing 200 μl 2YT/12.5 μg/ml CM per well were inoculated with 5 μl of −80° C. glycerol stock cultures each from the master plates and incubated overnight. The 96 clones of each plate were pooled by taking 20 μl of culture from each well and this procedure was repeated for 31 plates. Pooled cultures were centrifuged, the pellets were resuspended in sterile water, boiled for 5 minutes, centrifuged and the supernatants kept for PCRs. As an initial screening step, the 31 pools of a total of 2976 BACs, representing about two thirds of the library were tested for the presence of a specific clone using appropriate PCR primers. PCR was performed using 10 μl of supernatant, 5 μl of assay buffer (100 mM b-mercaptoethanol, 600 mM Tris HCl (pH 8.8), 20 mM $MgCl_2$, 170 mM $(NH_4)_2SO4$), 5 μl of Dimethylsulfoxide (DMSO), 5 μl of dNTPs (20 mM), 5 μl of water, 10 μl primer (2 μM), 10 μl inverse primer (2 μM) and 0.2 units of Taq DNA polymerase (Boehringer). 32 cycles of PCR (95° C. for 30 s, 55° C. for 1 min 30 s, 72° C. for 2 min) were performed after an initial denaturation at 95° C. for 1 min. An extension step at 72° C. for 5 min finished the PCR. If a pool of 96 clones yielded an appropriate PCR product (FIG. 1A), subpools were made to identify the specific clone. Subpools representative for lane A of a 96 well plate were made by pooling clones 1 to 12 from lane A into a separate tube. Subpools for lanes B to H were made in the same way. In addition, subpools of each of the 12 rows (containing 8 clones each) were made, so that for one 96 well plate, 20 subpools were obtained. PCR with these 20 subpools identified the specific clone (FIG. 1B, lower gel portion). If more than one specific clone was present among the 96 clones of one plate (FIG. 1B, upper gel portion), additional PCR reactions had to be performed with the possible candidates (data not shown).

11. Genomic comparisons. DNA from the BAC clone Rv58 was digested with the restriction endonucleases EcoR1 and PvuII, and resolved by agarose gel electrophoresis at low voltage overnight (1.5 V/cm). DNA was transferred via the method of Southern to nitrocellulose membranes (Hybond C extra, Amersham) following standard protocols (Sambrook et al., 1989), then fixed to the membranes at 80° C. for 2 hours. The blot was hybridized with $^{32}P$ labelled total genomic DNA from *M. tuberculosis* H37Rv, *M. bovis* type strain (ATCC 19210) or *M. bovis* BCG Pasteur. Hybridization was performed at 37° C. overnight in 50% formamide hybridization buffer as previously described (Philipp et al., 1996b). Results were interpreted from the autoradiograms.

12. Computer analysis. Sequence data from the automated sequencer ABI373A were transferred as binary data to a Digital Alpha 200 station or Sun SparcII station and analysed using TED, a sequence analysis program from the Staden software package (Dear et al., 1991). Proof-read sequences were compared using the BLAST programs (Altschul et al., 1990) to the *M. tuberculosis* H37Rv sequence databases of the Sanger Centre, containing the collected cosmid sequences (TB.dbs) and whole-genome shotgun reads (TB_shotgun_all.dbs) (http://www.sanger.ac.uk/). In addition, local databases containing 1520 cosmid end-sequences and the accumulating BAC end-sequences were used to determine the exact location of end-sequenced BACs on the physical and genetic map. MycDB (Bergh et al., 1994) and public databases (EMBL, Genbank) were also used to compare new sequences, but to a lesser extent. The organization of the open reading frames (ORFs) in the polymorphic region of clone Rv58 was determined using the DIANA software established at the Sanger Centre.

EXAMPLES

Example 1

Construction of a pBeloBAC11 Library of *M. tuberculosis* H37Rv

Partial HindIII fragments of H37Rv DNA in the size range of 25 to 180 kb were ligated into pBeloBAC11 and electroplated into strain *E. coli* DH10B. While cloning of fractions I (25 to 75 kb) and II (75 to 120 kb) gave approximately $4\times10^4$ transformants (white colonies), cloning of fraction III (120 to 180 kb) repeatedly resulted in empty clones. Parallel cloning experiments using partial HindIII digests of human DNA resulted in stable inserts for all three fractions (data not shown), suggesting that the maximum size of large inserts in BAC clones is strongly dependent on the source of the DNA. Analysis of the clones for the presence of inserts revealed that 70% of the clones had an insert of the appropriate size while the remaining 30% of white colonies represented empty or lacZ'-mutated clones. Size determination of randomly selected, DraI cleaved BACs via PFGE showed that the insert sizes ranged for the majority of the clones between 40 kb and 100 kb with an average size of 70 kb. Clones with inserts of appropriate size were designated with "Rv" numbers, recultured and stored at −80° C. for further use.

Example 2

Direct DNA Sequence Analysis of BACs

To characterize the BAC clones, they were systematically subjected to insert termini sequencing. Two approaches, direct sequencing of BAC DNA and PCR with degenerate oligonucleotide primers (DOP), adapted to the high G+C content of mycobacterial DNA, were used. In a first screening phase, 50 BAC clones designated Rv1 to Rv50 were analysed using both methods in parallel. Except for two clones, where the sequences diverged significantly, the sequences obtained by the two methods only differed in length. Sequences obtained directly were on average about 350 bp long and for 95% of the clones both the SP6 and T7 end-sequences were obtained at the first attempt. Sequences obtained by DOP-PCR were mostly shorter than 300 bp. For 40% of the BACs we obtained only very short amplicons of 50 to 100 base pairs from one end. In two cases the sequence obtained with the DOP-PCR differed from the sequences obtained by direct sequencing, and in these cases *E. coli* or vector sequences were amplified (data not shown). Taking the advantages and disadvantages of both methods into account, we decided to use direct termini sequencing for the systematic determination of the SP6 and T7 end-sequences.

Example 3

Representativity of the Library

After having determined the end-sequences of 400 BACs a certain redundancy was seen. The majority of clones were represented at least 3 to 4 times. Maximum redundancy was seen in the vicinity of the unique rrn operon, as 2.5% of the clones carried identical fragments that bridge the cosmids Y50 and Y130 (FIG. 3, approximate position at 1440 kb). The majority of clones with identical inserts appeared as two variants, corresponding to both possible orientations of the HindIII fragment in pBeloBACII. This suggests that the redundancy was not the result of amplification during library construction, but due to the limited number of possible combinations of partial HindIII fragments in the given size-range of 25 to 120 kb. To detect rare BAC clones, a pooled PCR protocol was used. Primers were designed on the basis of the existing cosmid sequences and used to screen 31 pools of 96 BAC clones. When positive PCR products of the correct size were obtained, smaller subpools (of 8 or 12 clones each) of the corresponding pool were subsequently used to identify the corresponding clone (FIGS. 1A and 1B). With this approach 20 additional BACs (Rv401-Rv420) were found for the regions where no BACs were found with the initial systematic sequencing approach. The end-sequences of these BACs (Rv401-420) were determined by direct sequencing, which confirmed the predicted location of the clones on the chromosome. A 97% coverage of the genome of H37Rv with BAC clones was obtained. Only one region of ~150 kb was apparently not represented in the BAC library as screening of all pools with several sets of specific primers did not reveal the corresponding clone. This was probably due to the fact that HindIII fragments of mycobacterial DNA larger than 110 kb are very difficult to establish in *E. coli* and that a HindIII fragment of ~120 kb is present in this region of the chromosome (data not shown).

Example 4

Establishing a BAC Map

Using all end-sequence and shotgun-sequence data from the H37Rv genome sequencing project, most of the BAC clones could then be localized by sequence comparison on the integrated map of the chromosome of *M. tuberculosis* strain H37Rv (Philipp et al., 1996b) and an ordered physical map of the BAC-clones was established. PCR with primers from the termini sequences of selected BACs were used for chromosomal walking and confirmation of overlapping BACs (data not shown). The correct order of BACs on the map was also confirmed more recently, using 40,000 whole genome shotgun reads established at the Sanger Centre. In addition, pulsed-field gel electrophoresis of DraI digests of selected BACs was performed (FIG. 2) in order to see if the approximate fragment size and the presence or absence of DraI cleavage sites in the insert were consistent with the location of the BACs on the physical map (FIG. 3). Comparison of the sequence-based BAC-map with the physical and genetic map, established by PFGE and hybridization experiments (Philipp et al., 1996b), showed that the two maps were in good agreement. The positions of 8 genetic markers previously shown on the physical and genetic map were directly confirmed by BAC-end-sequence data (Table 2, FIG. 3). The position of 43 from 47 Y-clones (91%) shown on the physical and genetic map, which were later shotgun sequenced, was confirmed by the BAC end-sequences and shotgun sequence data. Four clones (Y63, Y180, Y251, and Y253) were located to different positions than previously thought and this was found to be due to book keeping errors or to chimeric inserts. Their present approximate location relative to the oriC is shown in FIG. 3: Y63 at 380 kb, Y63A at 2300 kb, Y180 at 2160 kb, Y251 at 100 kb, and Y253 at 2700 kb. A total of 48 BACs, covering regions of the chromosome, not represented by cosmids were then shotgun sequenced (Cole et al., 1997), and these are squared in FIG. 3. No chimeric BACs were found, which is consistent with the observations of other research groups for other BAC libraries (Cai et al., 1995; Zimmer et al., 1997). The absence of chimeric BACs was of particular importance for the correct assembly of the *M. tuberculosis* H37Rv sequence. The exact position of the BAC termini sequences on the chromosome will be available via the world wide web (http://www.pasteur.fr/MycDB).

TABLE 2

Identities of genetic markers previously shown on the integrated and genetic map of H37Rv. (Phlipp et al., 1996b) which showed perfect sequence homology with BAC end sequences.

| Locus | BAC end sequence | Description of genetic marker | Organism | GenBank Accession n° |
| --- | --- | --- | --- | --- |
| apa | Rv163SP6 | Secreted alanine-proline-rich | *M. tuberculosis* | X80268 |
| dnaJ, dnaK | Rv164T7 | antigen | *M. leprae* | M95576 |
| fop-A | Rv136T7 | DnaJ hsp | *M. tuberculosis* | M27016 |
| polA | Rv401T7 | Fibronectin binding | *M. tuberculosis* | L11920 |
| ponA | Rv273T7 | protein | *M. leprae* | S82044 |
| pstC | Rv103T7 | DNA polymerase I Penicillin binding | *M. tuberculosis* | Z48057 |
| recA | Rv415SP6 | protein | *M. tuberculosis* | X58485 |
| wag9 | Rv35SP6 | Putative phosphate transport receptor Homologous recombination 35-kDa antigen | *M. tuberculosis* | M69187 |

Example 5

Repetitive End-Sequences

Repetitive sequences can seriously confound mapping and sequence assembly. In the case of the BAC end-sequences, no particular problems with repetitive sequences were observed. Although nine clones with one end in an IS1081 (Collins et al., 1991) sequence were identified, it was possible to correctly locate their position on the map using the sequence of the second terminus. Moreover, these BACs were used to determine the exact locations of IS1081 sequences on the map. Five copies of this insertion sequence, which harbors a HindIII cleavage site, were mapped on the previous physical and genetic map. In contrast, BAC end-sequence data revealed an additional copy of IS1081 on the *M. tuberculosis* H37Rv chromosome. The additional copy was identified by six clones (Rv27, Rv118, Rv142, Rv160, Rv190, Rv371) which harbored an identical fragment linking Y50 to I364 (FIG. 3, at ~1380 kb). This copy of IS1081 was not found by previous hybridization experiments probably because it is located near another copy of IS1081, localized on the same DraI fragment Z7 and AsnI fragment U (FIG. 3, at ~1140 kb). Furthermore, the position of a copy of IS1081 previously shown in DraI fragment Y1 (FIG. 3, at ~1840 kb) had to be changed to the region of Y349 (FIG. 3, at ~3340 kb) according to the end-sequences of BAC Rv223. The positions of the four other IS1081 copies were confirmed by the sequence data and therefore remained unchanged. In total 6 copies of IS1081 were identified in the H37Rv genome in agreement with the findings of others (Collins et al., 1991).

In addition, a sequence of 1165 bp in length containing a HindIII site was found in two copies in the genome of H37Rv in different regions. The end-sequences of BAC clones Rv48 and Rv374, covering cosmid Y164, as well as Rv419 and Rv45, that cover cosmid Y92, had perfect identity with the corresponding parts of this 1165 bp sequence (FIG. 3, at ~3480 kb and ~900 kb). Analysis of the sequence did not reveal any homology with insertion sequences or other repetitive elements. However, as each of the two locations showed appropriate BAC coverage, chimerism of the sequenced cosmids Y164 and Y92 can be ruled out as the probable cause.

Example 6

Using BAC Clones in Comparative Genomics

The minimal overlapping set of BAC clones represents a powerful tool for comparative genomics. For example, with each BAC clone containing on average an insert of 70 kb, it should be possible to cover a 1 Mb section of the chromosome with 15 BAC clones. Restriction digests of overlapping clones can then be blotted to membranes, and probed with radiolabelled total genomic DNA from, for example, *M. bovis* BCG Pasteur. Restriction fragments that fail to hybridize with the *M. bovis* BCG Pasteur DNA must be absent from its genome, hence identifying polymorphic regions between *M. bovis* BCG Pasteur and *M. tuberculosis* H37Rv. The results of such an analysis with clone Rv58 (FIG. 3, at ~1680 kb) are shown here. This clone covers a previously described polymorphic genomic region between *M. tuberculosis* and *M. bovis* BCG strains (Philipp et al., 1996a). EcoR1 and PvuII digests from clone Rv58, fixed on nitrocellulose membranes, were hybridized with $^{32}P$-labelled total genomic DNA from *M. tuberculosis* H37Rv, *M. bovis* (ATCC 19120), and *M. bovis* BCG Pasteur. FIGS. 4A and 4B present the results of this analysis, where it is clear that several restriction fragments from clone Rv58 failed to hybridize with genomic DNA from either *M. bovis* or *M. bovis* BCG Pasteur. On the basis of the various missing restriction fragments, a restriction map of the polymorphic region was established and compared to the H37Rv sequence data. The localization of the polymorphism could therefore be estimated, and appropriate oligonucleotide primers (Table 1) were selected for the amplification and sequencing of the corresponding region in *M. bovis*. The alignment of *M. bovis* and *M. tuberculosis* H37Rv sequences showed that 12,732 bp were absent from the chromosomal region of the *M. bovis* type strain and *M. bovis* BCG Pasteur strain. The G+C content of the polymorphic region is 62.3 mol %, which is the same as the average genome G+C content of the *M. tuberculosis* genome, hence indicating that this region is not a prophage or other such insertion. Subsequent PCR studies revealed that this segment was also absent from the Danish, Russian, and Glaxo substrain's of *M. bovis* BCG, suggesting that this polymorphism can be used to distinguish *M. bovis* from *M. tuberculosis*. Analysis of this sequence showed that 11 putative open reading frames (ORFs) are present in *M. tuberculosis*, corresponding to ORFs MTCY277.28 to MTCY277.38/accession number Z79701-EMBL Nucleotide Sequence Data Library (FIG. 5). FASTA searches against the protein and nucleic acid databases revealed that the genes of this region may be involved in polysaccharide biosynthesis. Among these putative genes, the highest score was seen with ORF 6 (MTCY277.33), whose putative product shows a 51.9% identity with GDP-D-Mannose dehydratase from *Pseudomonas aeruginosa* (accession number U18320—EMBL Nucleotide Sequence Data Library) in a 320 amino acid overlap. The novel *M. bovis* sequence of the polymorphic region was deposited under accession number AJ003103 in the EMBL Nucleotide Sequence Data Library.

As it appears from the teachings of the specification, the invention is not limited in scope to one or several of the above detailed embodiments; the present invention also embraces all the alternatives that can be performed by one skilled in the same technical field, without deviating from the subject or from the scope of the instant invention.

TABLE 3

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv101
::::::::::::Rv101SP6.seq::::::::::::
AATACTCAAGCTTGCCCAGCCGTCGATGACAAGAAATATGTCCGCAAAAGACTCAGCGGCCGACTTTGCTCGCAGCTG (SEQ ID NO. 6)

GCGGTACCGCGCCACCGATTCTATGCCGTGGTCGCGGAAAAATGCCTCCCGAAATCGCACGGCCGACTCCAGTTCGGC

GAGCATCCGCGATGCCAGCTGCGGCTGCGCCCTGCCGGCCACGGCACCCACATGCGGCAGTTCGTCCACCTGGGCCAG

CGCCCCGCCGCCGAATTCCAAACAATAGAACTGCACCCGGCCCGCATCGTGGGTAACAGCCAACGCCATGATCAGCGT

CCGCAGCGCGGTTGACTTGCCCGTTTGCGGTGCACCTACGAACGCGACATTGCCTGCGGCCCCGGACAAGTCGATCGT

GCGCGGCACCCGTGACTGCTCTAACGGGCGATTGAAATTCCGAT

::::::::::::Rv101T7.seq::::::::::::
CCACCCGTGTAATTTGGGATGGGCAAAAAGGCGAAGCACCGCGTGGCCACGAACGCCGGGAGGGACAATCTCGGGCGG (SEQ ID NO. 7)

TTAGGGCTTCTCGCGGGAAGGCCCGAACGTACGCCGTTTCAACACCTCGCGTCGCCCTCCGACCGCGAACATTCGGGG

ATGGCAGCAACCTGCTGGCACCCTGGCCGGGCGATGATCTGCAGCGTCGCCGCGGGTAGTCGCCGCCCGGGCGGCTAC

ACTCTGAAACGCGATGACCATCGATGTGTGGATGCAGCATCCCGACGCAACGGTTCCTACACCGCGATATGTTCGCCT

CGCTGCCCCGGTGGACCGGT

Clone Rv102
::::::::::::Rv102SP6.seq::::::::::::

AATACTCAAGCTTTCCGCCGATACCCGCCATGTCGCGCACATCCAGGACTTCTGGGGGGATCCGCTGACAGCGGCGGG (SEQ ID NO. 8)

ATCCCAAAGTGCGGATGATCGGGCCGCCTACGTCGTGGTGTACCTCGTCGGTAACAACGAAACCGAAGCGTATGACTC

GGTCCACGCGGTGCGGCACATGGTGGACACCACACCGCCACCGCACGGGGTGAAGGCCTATGTCACCGGTCCGGCAGC

ACTCAATGCCGACCAGGCCGAGGGCGGAGACAAAAGTATCGCTAAGGTCACCGCGATCACCAACATGGTGATCGCAGC

AATGTTGCTAGTGATCTATCGCTCCGTAATTACCGCGGTTCT

::::::::::::Rv102T7.seq::::::::::::
GTGCCGTTCCAACCCGAATTGGCTTTCGGCGCCATCGGTGAGGACGGCGTGCGGGTGCTCAACGACGACGTCGTCCGC (SEQ ID NO. 9)

GGGACACACCTCGATGCTGCCGCCATGGACGCGGTCGAACGCAAGCAGCTGATCGAGCTACAACGCCGCGCGGAACGC

TTCCGCCGCGGGCGTGACCGCATCCCGTTGACCGGGCGGATCGCGGTGATCGTCGATGACGGCATCGCCACCGGAGCG

ACGGCCAAGGCGGCGTGCCAGGTCGCCCGGGCGCACGGTGCGGACAAGGTGGTGCTGGCGGTCCCGATCGGCCCAGAC

GACATCGTGGCGAGATTCGCCGGGTACGCCGATGAGGTGGT

Clone Rv103
::::::::::::Rv103SP6.seq::::::::::::
AATACTCAAGCTTTCGGCGGAAACGGACACATTGCGAATATTGATGACAAAATAAAAATCATTGATGGTTTGAGTCAC (SEQ ID NO. 10)

CAGGCCGATCAAGCCTTCGCCGAGCCAAATTCCAATCAAGAGGCCCAAGCCCGTACCAATCAGCCCGGCAACGAGGGA

TTCCGTCATTATCAGCCAAAATAACTGCTCTCGGGTTACACCCAAACAGCGCAATATGGCGAAAAACGGTCGCCGTTG

CACGACATTAAATGTCACGGTATTGTAGATTAAAAGATACCCAC

::::::::::::Rv103T7.seq::::::::::::
TGCTCCCGAAACCTGGGGGTGTGCCTGCTCTGTATGCACGGCATACGGACATCCTTCCCCTGAGACCCGCCGTCGAAC (SEQ ID NO. 11)

CAGCCACGTGTCCATCATAGNGGGTCAACCCCGGCCAAGGGCGACGGCACGCCAAGTTCGCCGACCGTTAACCTAGTG

CTGTTAGCTTCATTTGCTGCGATCAAAACAGCTGGTCGGCCGTTAGGAACTGAATTGAAACTCAACCGATTTGGTGCC

GCCGTAGGTGTCCTGGCTGCGGGTGCGCTGGTGTTGTCCGCGTGTGGTAACGACGACAATGTGACCGGGGGAGGTGCA

ACCACTGGCCAGGCGTCGGCAAAGGTCGATTGCGGGGGGAAGAAGACACTCAAAGCCAGTGGGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv104
::::::::::::Rv104SP6.seq::::::::::::
ATACTCAAGCTTTGCCGACGAGCGGGCGATGTTGATGACGGGAAACCCCAGCGCACAACCGACGATTTTGGCGTAGCC (SEQ ID NO. 12)

GGCGGACGTCTGCTCGATTCCGATCACGTCGGCGCTCGCATCGAGCATGGCGCCGGCGACGGCTAGCAGCGATCCCCC

GTCGTCGAGGAGCACGACACGAGCCGTACGCCCGGCCGTAAGCCGCGCCCAGGATTCGGCGAAAAACCGTTCTACGTG

GCGGGTGTACTGGGTGTCGAATGATTCGTGGGGTGCGTAGGCGTCGCTGCAATCGTCGACATAGATGCCGTCGGGCCG

CATCGCGTCGACAACTCCGGGTGAGTGGAATAGCACTTGCCGATCACCGCGACGTTGCGCGGATGAGGCGGAACCCGA

ATA

::::::::::::Rv104T7.seq::::::::::::
TCCTATGTCCCTGCCGAGCANGTGATCGAACGCGGTGACAGATTTGTCTATCCTGGACCTGACGGTGAGGTCGAAGTT (SEQ ID NO. 13)

TTCCAGGAATTCGGCAAAATCGGTAAGAGCCTGAAGAATTCGGTATCGCCGGACGAAATCTGCGACGCATACGGGGGC

ATATACGCTTCGGGTTTACGAGATGTCGATGGGGCCGCTGGAGGCTTCACGTCCATGGGCCACAAAGGATGTTGTCGG

CGCGTACCGTTTTCTGCAGCGGGTGTGGCGCTTGGTCG

Clone Rv105
::::::::::::Rv105SP6.seq::::::::::::
ATACTCAAGCTTGATTCCGCCGAAACCGACCGTGAGCACCCCGCCAGCCACCACGCTCGGGTCGGGCGCCGGGCCCGG (SEQ ID NO. 14)

GCCGCCAGGCTGCTCCGCTCGGTGATGGCACGCCACCGCGACACCACCCGGCTGCGCTACGTCTAACCATTCCAGGCG

GAGCTACATCAGCTCGGCCGCCCAGTGTTCGGGCCCTCTTTCCAGGTCGAAGTCTATACCGATATGCGCATCCGCAGC

CGCCACCCTGGAGAACAGAACGATGCCCTACTAATGCTTGTCTGGCGGGGCC

::::::::::::Rv105T7.seq::::::::::::
GGTACGCTTCGGTCGCAGTCTGCGAGTGATGCATGACGACCGGGACCTCGTCGGCATCTTCCATAGCCCGCCACACCT (SEQ ID NO. 15)

TCAGTTGCTCACCGGAATCCAACCGGTAGAAGGTCGGCGAGCGCTCGGCATTGGTCATCGGGATATGCCGCTCGGGAC

GGTCAGAGCCCTCGGGTCCGGCCAGCACTCCGCAGGCTTCGTCGGGGTGGTCGCGACGCGCATGGGCCACCATCGCAT

TCACCAGGTCTGCGCGAATCACCAGCACGTAGACGGTTCCTTTCCTAAGCAACACCGAAGTTTCAGGACCCGAATGCT

CCGGGAAACATGTCACGGTAGGTCGGTATTCCGGCTACCGGCTGA

Clone Rv106
::::::::::::Rv106SP6.seq::::::::::::
GGCGTCAACGGTGTCGGAACCCGCGTCAAGCAATTGGTAGGCCTGCAGTCTGTGAATCAGGCCGACGCTGTGGCCGCC (SEQ ID NO. 16)

GCGGC

::::::::::::Rv106T7.seq::::::::::::
GGCTNGCGTACCCGGTACCGGCCGCGGGCCTACCACGTGCCGGAACTGGAAGCGCAGTAAGCCCTCAACGCGCCACCG (SEQ ID NO. 17)

CTTTGGCCCGCGCGCCCGGCGTAGGCGCATCGGCGGTGGCCGTGGGGCGGCGCACTGCGACCTCACCAGCGGCTTTCG

AGCTTTGTTCGATCAACCGGCCAGCATGGTCGANGATGCATTCGAGACCATATTCGAAATTGGTTTCATCGGGGGCCC

CGATCCGATGCCCCCTCCCAGTTGCGTGAGCAANCAGCGGAGTCNTCGCGGGATCGATGGCCACGGGGTGTTCAATGG

CGGATGGTCCGCTGCCCGCCGACTGGCTCTTGCGGGAGAACCGATCTAGCACCACCGATCCGCGCACGTNG

Clone Rv107
::::::::::::Rv107T7D4.seq::::::::::::
CGTAATNTCGCGCACANCCANGACTTCTGGGGGGATCNGCTGACAGTGGTNGGATCCCAAATTGCGGATGATCGGGCC (SEQ ID NO. 18)

GCCNACGTCGTTGTGTACCTCNTCNGTCACAACNAANCCGAANCGTATGACTCGGTCCACGCGGTGCGGCACATGGTG

GACACCACACCGCCACCGCGCGGGGTGAAGGCCTATGTCACCGGTCCGGCAACACTCAATGCCGACCAGGCCGANGCC

GGACACNANAGTATCNCTAACGTCACCGCGATCACGAGCATGGTGATCGNNCAATGTTNCTANTGATCTATCGCTCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TAATTACCGCGGTTCTCGTCTTGATCATGGTCGCANCGAACTCCGGCGCAATCCGCGGATTCATCGNCTTGCTGCCCG

ATCACATATTTTCAGCCTTTCACATTGCAACNAACCTGCTCGTCTCATGGNGATGCGGCGACACGGACTACCGATATC

ATGCTCGCCGTTACACAATCNCGCCACGCCGCGAAGACNGGAAACGCTTCTACACAATNTTCNCGGGACGCCACTNAA

CTTGGTTCNGGTTTGACATTGCCGCGCATGTNTGCCCAGCTTTGCCGGCTCCCCTTA

Clone Rv108
::::::::::::Rv108T7D4.seq::::::::::::
TGAATTTCCCGATCCCACAATCTCGGTTCAGATACAGGTCGCCATACCCCTTACTTCGGCAACGCTGGGCGGATTGGC (SEQ ID NO. 19)

CCTGCNGCTGCAGCANACCATCGACGCCATCGAATTGCCGGCAATCTCGTTCAGCCAATCCATACCCATCGACATTCC

GCCGATCGACATCCCGGCCTTCNCCCTTTAACGG

Clone Rv109
::::::::::::Rv109SP6.seq::::::::::::
AACAGCTATGACCATGNTTACGCCAAGCTATTTAGGTAACACTATANAATACTCAAGCTTTTACGGTGATCGCGCATC (SEQ ID NO. 20)

ACCTGGTTCATGAACTGGAAGCAGCGCANCGCTTCCTTTTCGGCCGCAACATGAGCCAGCCTCTCGTCCGCGGTCNGG

TGCAGGTGCTCGGGCAGCTCGGCCGCGACAGCCGCCTGACCCTGAAACCAGCTTCCATATCCCGCGACNAACNACNCC

AGTCCGCTACGTAACCCCTCCGCGACTGTCCATGGACAACAGCGCGTTCTCCACCGACCGGGCCCGGGTGTGGGGTGT

TTCGGCGACCGGCAGCCAGGTGGTCCACACTGCCGACGGGCGCCGCGAGCCGTTCACCGACCAAGCCGCCGAACAAGT

CCGCCCGATCGCATACTCCAACCGGTTGCGGTACTGCAGGTCAGCTGGCGTACCTCCTCNTCNCGCTCGGCGAAGTCT

TGCTCCANCACGTCGCAGAACGGCAAGGAACACGTTCA

::::::::::::Rv109T7.seq::::::::::::
GACCGNNCCATGTTTCCACAATGTGGTGCCAGTNCGGNGGCTACGTGCCATCNANACACTGGCGCAGGCTATCGCACC (SEQ ID NO. 21)

CGTTATCNGCTACGAACAAATCNCGGTATGCGTTCTTTANCATGAGTCGGCGACCGNCGATCATGGTCGACACCCACG

ACNGAAATACGCAGATCGCCNTCNAGCNTGTGTGCCGCGGATTATCANGACTGACCTCCTGGCTGACCGGNNTGTNTG

GTCGCGATGCCTGGCGCCCGGCCGGCGTGNTCGTGGTCGGCTCGGATAGCGAAGTCAGCTAATTCTCGTGGCAGCTCG

AAAGGGTCCTGCCGGTGCCGGTCTTTGCGCAAACCATGCNCATGTTACGGTCCCTCGGGTGCGGCCTGGCGGCGGC

Clone Rv10
::::::::::::Rv10SP6D2.seq::::::::::::
GGGATGGGCGGGCCCGCTAAACTCTTCGTGTTCCACTAACTCCGGGAGGGNCAATCTCGGGCCGTTATGGCTCACGTC (SEQ ID NO. 22)

GCGTCGCCCTCCGACCGCGAACATTCGGAGTTGGCAGCAACCTGGTAGCACCCTGGCCGG

::::::::::::Rv10T7D4.seq::::::::::::
NCCGTCGTTGACAAGTAAATATGTCCGCAAAAGTCTCAGCGGCCGACTTTGCTCGCAGGTGGCGGTACCGCGCCACCG (SEQ ID NO. 23)

AGTCGATGCCGTGGTCGCGGAAGAATGCCTCCCGAAATCGCACGGCCTTCCCNNTTTAAACGGA

Clone Rv110
::::::::::::Rv110SP6.seq::::::::::::
TTTAGGTGACACTATAGAATACTCAAGCTTTTGGTCTAGCCGGCCGAGCACGATACGGGTGTCATTGGCCACCGGCGG (SEQ ID NO. 24)

CGGCTGTCCGGGAAATGGCGGGTCCCCGGTGGTTTTGCTGATGAGTGCTGAACCGTANTCGAAGTGGGCGGCGTCAGA

CTCCACCCANCCAGCAGGCAGCGCGAAGCTGAATCCTCCAACCGGGTTGTCNATCCGGACAAGTTGGGGTGCGTTTGG

GGCAATGACAGGTGGCNGCGGTGCGTTCGGGTCCGCCGGCGGAAGTGCTGCGTTGGGATCNCCCGCTGGGCATTCGGC

NTTTTTGCGGCGGCCGGTGGTNGGGGGGCAACAGGTNTCCCNGTGCGGGTGGCGCTCAACGGTCNACGGCGCAAGCCG

CCGTTGTTGGTACCNGGGGCGCTGGCTCCGGATCGCGTTGGCGGTCNCCGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv110T7.seq::::::::::::
CTACACCATCGAATACGACGGCGTCGCCNACTTTCCGCGGTACCCGCTCAACTTTGTGTCGACCCTCAACGCCATTGC (SEQ ID NO. 25)

CGGCACCTACTACGTGCACTCCAACTACTTCATCCTGACGCCGGAACAAATTGACGCAGCGGTTCCGCTGACCAATAC

GGTCGGTCCCACGATGACCCAGTACTACATCATTCGCACGGANAACCTGCCGCTGCTAGAGCCACTGCGATCGGTGCC

GATCGTGGGGAACCCACTGGCGAACCTGGTTCAACCAAACTTGAANGTGATTGTTAACCTGGGCTACNGCGACCCGGC

CTATGGTTATTCNACCTCNCCGCCCAATGTTGCGACTCCGTTCGGGTTGTTCCCANAAGTCNNCCCGGTCGTCATCGC

CGAANCTCTCNTCCCGGGACCCACAGGGAATCNGCNATTTCNCCTACAAATCANCCACCTCCA

Clone Rv111
::::::::::::Rv111T7.seq::::::::::::
GCATGATCGGCCACCTTTCGGGCCGCCCGGCATACGGCGGCGTACCGATCTCCGCGTCATACACCCGCGGGTAATCGC (SEQ ID NO. 26)

CGACGGTGCCGGTTCGCGAGCCGAAGGTGACGACTCTGATTGAATCGAGTTCCAGGTCCAGCGGGTGGCGCACCAACG

GCGCGAGCTCAACGACGTCAATCNCGTTGTCGCTTTCTACGGTCACCGACCCTGGTCACCGTAGTTCNCCCG

Clone Rv112
::::::::::::Rv112SP6.seq::::::::::::
GACACTATAGAATACTCAAGCTTGCCAACCGCCAGCCTGCATCCGGCGGCGANCACTGCTCCGCCGACCAGTACGAAC (SEQ ID NO. 27)

CAACCTGCGGTGCCCAGGCCATTGACGATGTGCTGGTCGGCGCCCGCGAGTCCGCGCACCATCAACGCCGCGGGCACC

ACCANGGCGGCCCCACCCTGCACGGCGACGATCATTCCGGCGCCGCTCACGGCGGGCGGGGCTCGAACANGCACAGCA

TCAACGTNGTCACCCGGCCGTGACCGGCCCGCATCGTCACACCACCCAAGCCCATTGCCGTCCTCCTCAACNGGGCGA

CCCGGCCCGCATCGTCACACGGNCTAAGGCCATTGCCGTCCTCCT

::::::::::::Rv112T7.seq::::::::::::
TCGGCGCCATCGGCACCTTCGAGGACCTGTATTTCGACGCCGTGGCCNACCTGAGGTTGGCGGTGGACNAAGTGTGCA (SEQ ID NO. 28)

CCCGGTTGATTCGCTCGGCCTTGCCGGATGCCACCCNGCGCCTGGTGGTCGATCCGCNAANAGACAANTTGTGGTGGA

NGCTTCTGCTGCCTGCGACACCCACNACGTGGTGGCACCGGGCAGCTTTAGCTGGCATGTCCTGACCGCGCTGGCCGA

CNACTCCAGACNTTCCACNAANGGTCGCCNNCCCAATGTNCCGNANTGTCTCCGGNTCCCTTTACCNCCCAATGGGCN

GNTTCCACNGGTTACGGGCCCCNTNCCGGCGGGTCTNCCTCCCAANCTACCAAATACGCCCGACNTTCCGGA

Clone Rv113
::::::::::::Rv113SP6.seq::::::::::::
ATACTCAAGCTTTTATGGTGATCGCGCATCACCTGGTTCATGAACTGGAAGCAGCGCAGCGCTTCCTTTTCGGCCGCA (SEQ ID NO. 29)

ACATGAGCCAGCCTCTCGTCGGCGGTCGGGTGCAGGTGCTCGGGCAGCTCGGCCGCGAACAGCCCGGCTTGAACCCTG

AAAACCNGCTTTCCATATCCCGCGACGAAAGAACGCCAGTTCCGCTACTTAACCCCTCCGCGAACCGTCCATGGACAA

CAGCGCGTTCTCCACCAACCGGGCCCGGGTGT

::::::::::::Rv113T7.seq::::::::::::
TCGGCTCAGGCCGCGCTGCTGGTAGAGTCGCTGACCGGTGCAGGTTTCGACAATGTGGTGCCGGTTCGGCGGCTACGT (SEQ ID NO. 30)

GCCATCGAGACACTGGCGCAGGCTATCGCACCCGTTATCGGCTACGAAGCAAATCGCGGTATGCGTTCTTGAGCATGA

GTCGGCGACCGTCGTCATGGTCGACACCCACGACGGAAAGACGCAGATCGCCGTCAAGCATGTGTGCCGCGGATTATC

AGGACTGACCTCCTGGCTGACCGGCATGTTTGGTCGCGATGCCTGGCGCCCGGCCGGCGTGGTCGTGGTCGGCTCGGA

TAGCGAGGTCAGCGAATTCTCGTGGCAGCTCGAAAGGGTCCTGCCGGTGCCGGTCTTTGCGCAAACAATAGCGCAGGT

TACGGTCGCGCGGGGTGCGGCCTGGCGGCGGCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv114
::::::::::::RV114SP6.seq::::::::::::
CAAGCTATTTAGGTGACACTATAGAATACTCAAGCTTCGCGTCTACGCCGGCCCGGAGCATCCGCACAGCGCTCAGCA (SEQ ID NO. 31)

GCCGGTTCCGTACGANCTCAAGCAGGTGGCGCAATGACCGAAACCACCCCAGCCCCGCAAACCCCGGCGGCCCCGGCC

GGGCCCGCACAATCGTTCGTGTTGGAGCGGCCCATCCANACCGTTGGGCGCCGTAAGGANGCCGTGGTACGAATGCGC

CTGGTGCCCGGCACCGGCAAGTTCGACCTCAACGGCCGCAGCTTGGANGACTACTTCCCAAACAAGGTGCACCAGCAG

TTGATCAAGGCACCCCTGGTCACCGTGGATCGGGTGGAAAGTTTCGACATCTTTGCCCACCTGGGCGGCGGCGGCCGT

CCGGTCAGGCCGGGCCTGCCCTGGGTATCGCCCGGGCATTGATTCTGGTATCCCCNGAAGAACCG

::::::::::::Rv114T7.seq::::::::::::
CGGTTGGCCACCGCTTCTGCGGTGCCGCCGCCGTCGACAATGACCGTGTCGTCCTTGCTGACCACCACGCGTCGGGCC (SEQ ID NO. 32)

GAGCCCAGCACCTCCAAGCCCACCTCGCGCAGCACCATGCCGGCGTCGGGGTTGACCACCTGGCCACCCGTCACCACC

GCCAGGTCCTCAAGGAAACGCCTTACGGCGGTCACCGAAGTACGGCCCCTTGACCGCGACCGCTTTCAACGTCTTGCG

AATCGCGTTGACGACCAGCGTCGCCAACGCTTCGCCCTCCACGTCTTCAGCCACGATCAGTAGTGGCTTACCCGTTCC

TGCAACCTTTTCCAGCAATGGCAACAGATCGGGAAGCGANCTGATCTTGTCTTGGTGCN

Clone Rv115
::::::::::::Rv115SP6.seq::::::::::::
CCAAGCTATTTAGGTGACACTATAGAATACTCAAGCTTTTGGCTGGGTCGCCTTCGAATTCNGCGTGCACCGCTATGG (SEQ ID NO. 33)

GTTGCANCAGCGGCTGGCGCCGCACACCCCACTGGCCCGGGTGTTTTCGCCCCGAACCCGGATCATGGTGAGCGAAAA

GGANATTCNCCTGTTCGATGCTGGGATTCGCCACGCCAAGGCATCTANCGATTACTCTCCNCGGGGTGGGAAAAGTGC

CCAATCCCCCTCCCTCCAACTTTCCNAACAATCATTCCGGTTCCNCCNTCCGGTTGGNGGTAACCNNCCAATAAAACC

CCTGCCCG

::::::::::::Rv115T7.seq::::::::::::
GCCCGCNCATGGCCAATCCCCGAAGACATCATTGGCCAGTGGCCGGGCGCTAACAGGTTCCAGCCCCCCACCANTGCC (SEQ ID NO. 34)

GCTCGAACATGCGGTGCAACCCATTCGCAGGCCGGCAGGGAAAGCACCGCGGAAGCCGCAAAGGGCTGCAGTTCCGCG

CCCAATAATGTCGTCCGCAACCAGATGCGCTCNAAAACCNCNCCGGCAGTCAGCGCACCCGACGCGANGTCGAAAGAC

GTCNTCAGCGCGCCCACATGGGGTGCCAATCGGCACGGCAGGTATGCCGCGCGCAACCCGAGCGCGTGGTGCATGCCC

ACGGTCCGCANGANGCGCANCACCCGCCAATGCCGAANCCCACGAAACATCGGGCGCATCCACCTTCAACC

Clone Rv116
::::::::::::Rv116SP6.seq::::::::::::
ATACTCAAGCTTGCCCAGCCGTCGATGACAAGAAATATGTCCGCAAAAGACTCAGCGGCCGACTTTGCTCGCAGCTGG (SEQ ID NO. 35)

CGGTACCGCGCCACCGAGTCGATGCCGTGGTCGCGGAAGAATGCCTCCCGAATTCGCACGGCCAATTCCATTCCGGGA

AGCATCCGCAATGCCAGCTGCGGTTGCCCCCTGCCGGCCACGGCACCCACTTGCGGCATTGCGTCCACCTGGGCCAGC

GCCCCGCCGCCAAATTCCAAACAATAAAAATTGCACCCGGC

::::::::::::Rv116T7.seq::::::::::::
CCACCCGTGTATTTTGGGATGGGCAAAAAGGCGAAGCACCGCGTGGCCACGAACGCCGGGAGGGACAATCTCGGGCCG (SEQ ID NO. 36)

CTAGGGCTTCTCGCGGGAAGGCCCGAACGTACGGCGTTTCAACACGTCGCGTCGCCCTCCGACCGCGAACATTCGGGG

ATGGCAGCAACCTGGTAGCACCCTGGCCGGGCGATGATCTGCAGCGTCGCCGCGGGTAGTCGCCGCCCGGGCGGCTAC

AGTCTGAAACGCGATGACCATCGATGTGTGGATGCAGCATCCGACGCAACGGTTCCTACACGGCGATATGTTCGCCTC

CCTGCCCCGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv117
::::::::::::Rv117SP6D2.seq::::::::::::
CTGCCCATGTTTGGGGACGCCCGACCAGCCGATGCTGGAGGCCTACACGGCCCTTGGTGCGCTGGCCACGGCGACCGA (SEQ ID NO. 37)

GCGGCTGCAACTGGGCGCGTTGGTGACCGGCAATACCTACCGCAGCCNGACCCCTNTCNCAANAGGATNTTGTTCGCC

GGACCCCNCTC

::::::::::::Rv117T7D4.seq::::::::::::
CCGACTTTCCGCGGTACCCGCTCAACTTTCTCTCGACCCTCAACGCCATTGCCGGCACCTACTACGTGCACTCCAACT (SEQ ID NO. 38)

ACTTCATCCTGACGCCGGAACAAATTGACGCAGCGGTTCCGCTGACCAATACGGTCGGTCCCACGATGACCCAGTACT

ACATCATTCGCACGGAGAACCTGCCGCTGCTAGAGCCACTGCGATCGGTGCCGATCGTGGGGAACCCACTGGCGAACC

TGGTTCAACCAAACTTGAAGGTGATTGTTAACCTGGGCTACGCGACCGCCTTT

Clone Rv118
::::::::::::Rv118SP6.seq::::::::::::
ATACTCAAGCTTTGTCACACCAAGTGTTTCGACCAGGCGCTCCATCCGGCGAGTGGATACTCCCAGCAGGTAGCAGGT (SEQ ID NO. 39)

CGCCACCACGCTGGTCAGTGCGCGTTCAGCTCGCTTGCGGCGCTGCAGCAGCCATTCGGGGAAATACCTGCCCTGGCG

CAGCTGGGGGATCCCAACTTCAATGGTTGCGGCACGGGTGTCAAATTCACGGTGGCGGTAGCCGTTGCCCTAATTGGA

CCGCTCATCGCTGCTTTCGCGGTACCCCGCCCCGCACAGGGCTTCGGCTTCAGCCCCCATCAGGGCGGCAATAAACTT

CAAGAGCACC

::::::::::::Rv118T7.seq::::::::::::
GAGGCAGCTTCGCCGGCAATTCTACTAGCGAGAAGTCTGGCCCGATACGGATCTGACCGAAGTCGCTGCGGTGCAGCC (SEQ ID NO. 40)

CACCCTCATTGGCGATGGCGCCGACGATGGCGCCTGGACCGATCTTGTGCCGCTTGCCGACGGCGACGCGGTAGGTGG

TCAAGTCCGGTCTACGCTTGGGCCTTTGCGGACGGTCCCGACGCTGGTCGCGGTTGCGCCGCGAAAGCGGCGGGTCGG

GTGCCATCAGGAATGCCTCACCGCCGCGGCACTGCACGGCCAGTGCCGCGGCGATGTCAGCCATCGGGACATCATGCT

CGCGTTCATACTCCTCGACCAGTCGGCGGAACAGCTCGATTCCCGGACCGCCCAGCGCATTGGTGATGGAATCGGCGA

ACTTGGCCACCCGCTGGGTGTTGACATCCTCGACGGTGGGCAATTGCGCCTCGGTAAGCTTTGCCGCGTAGCCTTTTC

ATC

Clone Rv119
::::::::::::Rv119SP6.seq::::::::::::
ATACTCAAGCTTCACTGACAAGGGACGAATTCGTCGGCCGCCTGTTCGACTGGGTGGTGGCCGAGCTGGTCGCCACCA (SEQ ID NO. 41)

CTCAGGCCGCGGTCACGGCGGTACCGGCGCGGGAGCAAACTCGCGCGGGCATGGCCAACTTCTTGCGGACCATCACCG

CAGACGCCCGCTTCGGACCCCTGCTGTCCACCACACAGTTGGCCAACGCATTAATCACCCGCAAGCTTGCGGAATCCA

CCGCCCTGTTCGC

::::::::::::Rv119T7.seq::::::::::::
TCCATCACCCGATGTGGCNGGAGCACTGCCATGTCGATCTCAACTACCACCTCCGGCCGTGGCGGTTGCGCGCCCCGG (SEQ ID NO. 42)

GGGGTCCGCGCGAACTCGACGAGGCGGTCGGAGAAATCGCCANCACCCCGCTGAACCGCGACCACCCGCTGTGGGAGA

TGTACTTCGTTGAGGGGCTTGCCAACCACCGGATCGCGGTGGTTGCCAAAATTCACCATGCGTTGGCTGACGGTGTTG

CCTCGGCAAACATGATGGCACGGGGGATGGATCTGCCGCCGGGACCGGAGGTCGGCCGCTATCTGCCTGACCCCGCTC

CTACCAAGCGGCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv11
:::::::::::::Rv11SP6.seq:::::::::::::
AGCTTTGCAGTTGCTGAGTAATGTCGGCCAACGTCACCACAACCGCGATGAATTCAATCATGCCGCCCAGGGCGGCCA (SEQ ID NO. 43)

ACCCAATGGTGGCCGCGAGCGGCAGCTCGATCGCAGCGCGGAGGTTGCCGGCCGCCAGTTGATTCACGAACAGGGTGA

GGTCATAGGCGGGCAGGATAGTGACGAAGGCAAGACCTCCATCTGCCGTCGGAAGAAGTATCGAG

:::::::::::::Rv11T7.seq:::::::::::::
AGCTTCAGAACAGGCCTGTTGTGGGCCCACCCGGCTCGCCGAGTTCTGCACGCACCGCCTCAAGTGCGGCCCGCACCC (SEQ ID NO. 44)

CCGGCATCTCCCGGTCACGCAGGGCCGCGGCCCGCGCCGCAGCGACGGCGTGTTCGCCCAGTTCGCCGTCAATGATGC

TGACCTGATCGGCCACCCGGGCGTTCTCGGCGTCGTCGCGTTCACTAATCGCGGTGCTCAGCAGCGTCTCGACAGCCA

CCACCCGAGTGGCGACCAGCTGCTCCACCACGGACCGCAGCGATGCCCGTC

Clone Rv120
:::::::::::::Rv120SP6.seq:::::::::::::
ATACTCAAGCTTCAGTTCCTCCACGACGCGTTCCCAAATGAATTTCCCGATCCCACAATCTCGGTTCAGATACAGGTC (SEQ ID NO. 45)

GCCATACCCCTTACTTCGGCAACGCTGGGCGGATTGGCCCTGCCGCTGCACCAAACCATCAACGCCTTCAAATTGCCG

GCAATCTCGTTCAGCCAATCCAT

:::::::::::::Rv120T7.seq:::::::::::::
GCTCTACGCCGCCTACGGGTCGAACATGCATCCCGAGCAGATGCTCGAGCGCGCACCCCACTCGCCGATGGCCGGAAC (SEQ ID NO. 46)

CGGCTGGTTACCCGGGTGGCGGCTGACGTTCGGCGGCGAGGACATCNGCTGGGAAGGGGCGCTTGCCACCGTCGTCNA

AGACCCAAATTCGAAGGTGTTCGTCGTGCTCTACGACATGACCCCGGCGGACGAGAAGAACCTTGACCGGTGGGAAGG

CTCCGAGTTCGGTATCCACCAGAAGATCCGATGCCGCGTGGAGCGCATTTCCTCGGACACCACAACGGGATCCCGTCC

TCG

Clone Rv121
:::::::::::::Rv121SP6.seq:::::::::::::
ATACTCAAGCTTGCCAAAGAGACCTCGTCCACCAAGCAGGACGCGACCGTCGAGGTGGCGATCCGGCTTGGCGTCGAC (SEQ ID NO. 47)

CCGCGTAAGGCAAACCAGATGGTTCGCGGCACGGTCAACCTGCCCACACCGGCACTGGTTAAGAACTGCCCGCGTCGC

GGTTTTCGCGGTTGGTGAAAAGGCCAATGCCTGCGTTTGCCGTGGGGGCGGATGTTGTCGGGAGTGACAATCTGATCA

AAAGGATTCAGGGCGGTTGGCTGGAATTCAATGCCGCAATCGCGACACCGG

:::::::::::::Rv121T7.seq:::::::::::::
CCACGGCGTGGATCAAGGTACCGGCCGGGATGTTGCGCAATGGCAGGTTGTTGCCCGGCTTGATGTCGGCGTTAGCGC (SEQ ID NO. 48)

CGGATTCCACCACATCCCCTTGCGAAAGTCCGTTGGGTGCAATGATGTAGCGCTTCTCCCCATCGAGATAGTGGAGCA

ACGCAATCCGTGCGGTACGGTTCGGGTCGTACTCGATGTGCGCGACCTTGGCGTTGACACCATCTTTGTCATTGCGGC

GAAAGTCGATCATCCGGTAAGCGCGCTTATGACCGCCGCCTTTGTGCCGGGTGGTAATCCGGCCATGCGCGTTGCGTC

CACCGCGACCTGCAGCGGGCGCACCAGCGACTTCTCCGGGGTTGACCGGGTNATCTC

Clone Rv122
:::::::::::::Rv122SP6D2.seq:::::::::::::
GCAGCATGACGGCGGTAGCGAACACCGCCGGATGCAGCGCAAGTAGCGTCGATGTGCTCACGGAATCGCCCCGGCACC (SEQ ID NO. 49)

GCGATCTCGANGATCACCAGTGCCACCCCCTGCAGCGCNACACCGACGATTCCGTACACCGCCACGCCGATCAGGCCC

TGGGCCATCTGATTGGAGCTGGCGTANATGGCGGCGATGGTGACGATGGCCAGCGCCACATACATTGTGGCGGCCAGA

ACCACGGCGTTGGGGCGGCGGTCGATGAACACTAGGCGACGCAGATCGCCCGGGGTCAACAGGTTGACCATCAGAAAG

CCTGCGACTAGCACGGCGGCGCCACTAGGAAGTACAAGAANGTGGCCACCACCCCATCCAGGATCGGGGTAAGGCTGA

TGGTCCCGAAATCGACTCCGGCCTAATACATGACTCTCTCCTTTGCGTCATCGCCTTACTTGTGCGCGGAA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv
:::::::::::::Rv123SP6D2.seq:::::::::::::
GGGACACACCTCGATGCTGCCGCNATGGACGCGGTCGAACGCAAGCAGCTGATCGAGCTACAACGCCGCGCGGAACGC (SEQ ID NO. 50)

TTCCGCCGCGGGCGTGACGCATCCCGTTGACCGGCCGGANCNCTCTCTA

:::::::::::::Rv123T7D4.seq:::::::::::::
TGGGCGCCTCTTTCGGCCTTCCCNNTTTAAACGNAGCANGACATTCTGGGTATCGAGTTGTACTGGATGGTGTTGGCG (SEQ ID NO. 51)

ATGTCGGTGATCCTGCTCCTGGCGGTGGGATCCGACTACAATCTGCTGCTGATTTCCCGGTTGAAAGAGGAAATTGGG

GCCGGATTGAACACCGGAATTATCCGTGCCATGGCTGGTACCGGGGGAGTGGTGACGGCTGCCGGCATGGTGTTCGCC

GTTACCATGTCGTTGTTTGTGTTCAGCGATTTGCGAATTATTGGTCAGATCGGTACCACCATCGCCTTCCC

Clone Rv124
:::::::::::::Rv124SP6D2.seq:::::::::::::
CCGATCGGCGCCGCANCTGGTTGGTGTTNCGGATGAATCCGCAGCGAAAATGTAGCTGCGGTGGCGTGTCGTGACTCG (SEQ ID NO. 52)

TNGGCGTCGACGCTCGTGGCAGCCACCGANCGGTTGGTCCAGGATCTGGATGGGCAAAGTTGTGCGGCCCGGCCGGTG

ACGGCCGATGAGCTGACCGAGGTCGACAGCGCCGTGTTGGCTGACTTGGAACCGACATGGAGTCGCCCCGGTTGGCGT

CACCTCAAGCATTTCAATGGTTATGCGACCAGTTTTTGGGTTACGCCGTCAGACATCACGTCGGAGACTTGGATGAGC

TGTGTCTGCCAGATAGCCCCGAATCGGGACGACCGTGGTCACGGTGCGTCTGACCACTCGGGTCGGGTCGCCCGCGCT

ATCGGCATGGGTGCGTNATCACAGCGACACGCGCCTGCCCAAGGANGTNCGGNCGGACC

:::::::::::::Rv124T7D4.seq:::::::::::::
CGGGTTGCGGATCCACGCGTGCGGGTTGTCAGCAGCTACGGCACTGAACCGCGCCCACAGCTCGCCGATCCGCTTTCG (SEQ ID NO. 53)

GTGGTTCTCGATCGACTCGCCGTAGGCGATGCGCAGCGCCTGCTCGAATATCGGGTACACGTAGGCCGGCCTTCCCNC

TTTA

Clone Rv126
:::::::::::::Rv126SP6.seq:::::::::::::
CTTGATTTTGATCATCATGACGATCATCACCCTAATTTTGCTACCCGCACTGGTTATCGTGGGTACCGTCGTGCTTTC (SEQ ID NO. 54)

CATGGGCGCCTCTTTCGGGCTTTCCGTATTGGTCTGGCAGGACATTCTGGGTATCGATTTGTACTGGATGGTGTTGGC

GATGTCGGTGATCCTGCTCCTGGCGGTGGGATCCGACTACAATCTGCTGCTGATTTCCCGGTTGAAAAAGGAAATTGG

GGCCGGATTGAACACCGGAATTATCCGTGCCATGGCTGGTACCGGGGGAGTGGTGACGGCTGCCGGCATGGTGT

:::::::::::::Rv126T7.seq:::::::::::::
GGGGATCCCTAGATCGACCTGCAGGCATGCAAGCTTGGCGTGTCGTTCCAACCCGAATTGGCTTTCGGCGCCATCGGT (SEQ ID NO. 55)

GAGGCGGGACACACCTCGATGCTGCCGCCATGGACGCGGTCGAACGCAAGCAGCTGATCGAGCTACAACGCCGCGCGG

AACGCTTCCGCCGCGGGCGTGACCGCATCCCGTTGACCGGGCGGATCGCGGTGATCGTCGATGACGGCATCGCCACCG

GAGCNACTGTCAAGGCGGCGTGCCAGGTCGCCCGGGCGCACGGTGCGGACAAGGTGGTGCTGGCGGTCCCGATCGGCC

CAGACGACATCGTGGCGAGATTCGNCGGGTACGCCGATGAGGTGGTGTGTTTGGCGACGCCGGCGTNGTTCTTCGCCG

NCGGGCANGGTTACCGCAACTTCACCCAGACCTCCGACGACGAGGTGGTGGCGTCTCCTGGATCGTGCTC

Clone Rv127
:::::::::::::Rv127SP6.seq:::::::::::::
AAGGCTGCAGGTCGAAGCGGNTGGTTACGACTCCCTGTGTGTGATGGACCAGTTCTACTATCTGCGTCTACACGGCCC (SEQ ID NO. 56)

TTGGTGCGCTGGCCACGGCGACCGAGCGGCTGCAACTGGGCGCGTTGGTGACCGGCAATACCTACCGCAGCCCCGACC

CTGCTGGCAAAGATNATCACCACGCTCGACGTGGTTAGCGCCGGTCGAGCGATCCTCGGCATTGGAGCCGGCGGGTTT

GAACTGGAACACCGCCAGCTCGGCTTCGAGTCCGGCACTTCCAGTGACCGGTTCAACCGGCTCGA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv127T7.seq::::::::::::
CTTTCCGCGGTACCCGCTCAACTTTGTGTCGACCCTCAACGCCATTGCCGGCACCTACTACGTGCACTCCAACTACTT (SEQ ID NO. 57)

CATCCTGACGCCGGAACAAATTGACGCNGCGGTTCCGCTGACCAATACGGTCGGTCCCACGATGACCCAGTACTACAT

CATTCGCACGGAGAACCTGCCGCTGCTACAGCCACTGCGATCGGTGCCGATCGTGGGGAACCCACTGGCGAACCTGGT

TCAACCAAACTTGAAGGTGATTGTTAACCTGGGCTACGGCGACCCGGCCTATGGTTATTCGACCTCGCCGNCCAATGT

TGCGACTCCGTTCGGGTTGTTCCAGANGTCAGCCCGGTCGTCATCGCCGACGCTCTCGTCN

Clone Rv128
::::::::::::Rv128SP6.seq::::::::::::
CGGTCATAGCCCTCGGGTCCGGCCAGCACTCCGCAGGCTTCGTCGGGGTGGTCGCGACGCGCATGGGCCACCATCGCA (SEQ ID NO. 58)

TTCACCAGGTCTGCGCGAATCACCAGCACGTAGACGGTTCCTTTCCTAAGCAACACCGAAGTTTCACGACCCGAATGC

TCCGGGAAACATGTCACGGTAGGTCGGTATTCCGGCTACCGGCTGAGCATTGAGCACGCCGGCCAGCACCGCACGAGC

CAGGCAATCAGCCGCCGCCGCACCGATCGCGGTGACCAGCTGAGTCTCCGGAGACAATGCGGCCGGCACGCCGGNCTC

CGGCGGCACCGCTACNGCGCCCGTGG

::::::::::::Rv128T7.seq::::::::::::
GTGATGGCACGCCACCGCGACACCACCCGGCTGCGCTACNTCGAGCCATACCGGGCGGAGCTACATCGGCTCGGCCGC (SEQ ID NO. 59)

CCAGTGTTCGGGCCCTCTTTCGAGGTCGAGGTCGATACCGATTTGCGCATCCGCANCCGCNCCCTGGACGACAGAACC

GTGCCCTACGAGTGCTTGTCGGGCGGGGCCAAAGAACAGCTTGGCATCCTGGCGCGATTGGCCGGCGCGGCGCTGGTC

GCCAAGGACGACGCCGTTCCGGTGCTGATCGACGACGCGCTGGGGTTCACCGATCCGGAGCGACTATCAAGATGGGGG

AGGTCTCTGACACCATCGGCCCCNACGGACATGTGATCGTGCCGACGTGCAGTCCCACCCCG

Clone Rv129
::::::::::::Rv129SP6.seq::::::::::::
GCGAAAGTCCGTTGGGTGCAATGATGTAGCGCTTCTCCCCATCGAGATAGTCGAGCAACGCAATCCGTGCGGTACGGT (SEQ ID NO. 60)

TCGGGTCGTACTCGATGTCCGCGACCTTGGCCTTGACACCATCTTTGTCATTGCGGCGAAAGTCGATCATCCGGTNNG

CGCGCTTATGACCGCCGCCTTTGTGCCGGGTGGTAATCCGGCCATGCGCGTTGCGTCCACCGCGACCGTGCAGCGGGC

GCACCAGCGACTTCTCCGGGGTTGACCGGGTGATCTCGGCGAAATCAGATACGCTGGCGCCGCGACGACCAGGCGTCG

TGGGCTTGTNCTTGCGAATTGNCATGTCTAATCANGTCTTTCTCTCACGCTCTCGTCGCCGGGCTAGGCCGCATTGCC

CTGCTCCTCCTCATCGCTTCGCTCTGCATCGTCCCCGGGCTAAGCCCGTGCCCCGAAA

::::::::::::Rv129T7.seq::::::::::::
GATGGTTCGCGGCACGGTCAACCTGCCACACGGCACTGGTAAGACTGCCCGCGTCGCGGTATTCGCGGTTGGTGAAAA (SEQ ID NO. 61)

GGCCGATGCTGCCGTTGCCGCGGGGGCGGATGTTGTCGGGAGTGACGATCTGATCGAGAGGATTCAGGGCGGCTGGCT

GGAATTCGATGCCGCGATCGCGAACACCGGATCAGAATGGCCAAAGTCGGTCGCATCGCTCGGGTGCTGGGTCCGCGC

GGCCTGATGCCCAACCCGAAAACCGGCACCGTCACCGCCGACTCCCCATGGCGTCCCGGATATCAAGGGCCGGCAAAT

CAACTTCCCGGTTGATCAGCAAGGCAACCTGCCTCCNCCTCCGG

Clone Rv130
::::::::::::Rv130SP6.seq::::::::::::
ATACTCAAGCTTCGTCATAAGACCATGGTGCGCTTTCTTTCACCCGTCCAGAGTCGGGGGCATCCGCACCGGCTCGCA (SEQ ID NO. 62)

TCGCATCATCCTCCCACGACGGGCCGCTCATCAGCTTGGGCCATTTCAATGTACTTGATACCCCGCGCTGCGGGTAGG

CCACTGCGACAATTCAAACACGGTGTCACACGGTGAATAGTGTCGAGATGGGCTCTGATCAACCGTCGCAAACCCGGT

TTCGCATCAATAGCGGAATCCCACCGGGTTGCATGGAGGCTGCTGACCTTGGAAAACAAAATTTTTTCATTACAACAA

AACAACCGCCNCGGAAACTTTGCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv130T7.seq::::::::::::
CGAATTCGGCGTGCACCGCTATGGGTTGCAGCAGCGGCTGGCGCCGCACACCCCACTGGCCCGGGTGTTTTCGCCCCG (SEQ ID NO. 63)

AACCCGGATCATGGTGAGCGAAAAGGAGATTCGCCTGTTCGATGCTGGGATTCGCCACCGCGAGGCCATCGACCGATT

ACTCGCCACCGGGGTGCGAGAGGTGCCGCAGTCCCGCTCCGTCGACGTCTCCGACGATCCATCCGGCTTCCGCCGTCG

GGTGGCGGTAGCCGTCGATGAAATCGCTGCCGGCCGCTACCTGCAAGGTGATTCTGTCCCGTTGTGTCGAAGTGCCTT

TCGCGATCGACTTTCCGTTGACCTACCGGCTGGGGCGTCGGCACAACACCCCGGTGAGGTCGTTTTTGTTGCAGTTGG

GCGGAATCCGTGCTCTGGGTTACAGCCCCGAACTCGTCACGGCGGTGCGCGCCGACGGAGTTGTTATCACCGATCCGT

TGGCCGTACCGCGCCTTGGGC

Clone Rv132
::::::::::::Rv132SP6.seq::::::::::::
TCAGACTCCACCCAGCCAGCAGGCAGCGCGAAGCTGAATCCTCCAACCGGGTTGTCGATCCGGACAGGTTGGGGTGCG (SEQ ID NO. 64)

TTTGGGGCAATGACAGGTGGCGGCGGTGCGTTCGGGTCGGCCGGCGGAGGTGCTGCGTTGGGATCGCCCGGCTGGGCA

TTCNGCGTGTTGGCGGCGGCCGGTGGTGGGGGGGCAACAGGTGTCGCCGGTGCGGGTGGCGCTGCAGCGGTCGACGGC

GGCGAAGCGGCCGTTGTGGGTACCGGGGGCGCTGGCTCCGGATCGGCGTTGGCGGTCGCGGGCACCGCAACGGTCACC

AAGCTGGCGCTGGCCATCGCCGCGATAGCCAGTGCCGCCAATCGTCCCTTGCGACGTGTCAAGTNGGGGTCCACCTGA

TGCATGGCCAAAGAACCTACCGTGTTAACGGCNCAACNCAAGGACCGCGCCGGTCGCN

::::::::::::Rv132T7.seq::::::::::::
TTTCCGCGGTACCCGCTCAACTTTGTGTCNACCCTCAACGCCATTGCCGGCACCTACTACGTNCACTCCAACTACTTC (SEQ ID NO. 65)

ATCCTGACGCCGGAACAAATTGACGCAGCGGGTCCGCTGAACAATTCGGTCCGTCCCACGAAAGAACCAGTTTTNCNT

CTTTCNCACGGAGAACCTGCCGCTGCTAGAGCCACTGCGATCGGTGCCGATCGTGGGGAACCCACTGGCGAACCTGTG

TTTCAACCAACACTTAGAGTGTAATTGTAAACCTGGGCTAGGGGAAACCGGCTCTAGTTTTTCCACCNTCTCCGCCCC

NTGTTTCGAATACTCCGTTCGGGTTGTCCCCAAA

Clone Rv134
::::::::::::Rv134SP6.seq::::::::::::
GCTTCCGGCTCGTATGTTGTGTGGAATTGTGACCGGATACCAATTTCACACAGGAAACAGCTATGACCATGATTACGC (SEQ ID NO. 66)

CAAGCTAGTTAGGTGACACTATACAATACTCAAGCTTGCCGGCTGGTGGGCCGACCACTTCGATGGCACGACCCGTGA

ACTGCTGCCCGGCCAATTCTTCTTGGTCGCCCGGACCGATGGACCGCGGCTGGGATTCCAGAAGGTGCCCGATCCCCC

CCCTGGGAAAAACCGCGTGCACCTCTACTTCACGACCAACGAC

::::::::::::Rv134T7.seq::::::::::::
CCGATCGACTGATGCGCCGACAACCACGCCCCAACAACTGGAATGAACCGTCGTGACCATCATCAGCACGCGGTTGTA (SEQ ID NO. 67)

GGCGACTTGCGACATGTTCAACCCGCCGTACTCGGACGGAATCTTCAAACCGAAACAGCCCAGCTCGGCCAGGCCTTT

CACGTACTCGTCGGGGATCTGGGCACCACGCTCGAGGACGCTGCCGTCCACGGTGTCTAGGAATTCCCGCAGTTTGAC

CAGAAACGCCTCGGTTCGGGCCTCCTCGGCGTCCGACGGCTTGGGAAATGGGTGTATGAGCCCTACGGGAAACCGGCC

CACAAAGAGTTCTTTGGCGAAGGACGGTTTATCCCAACCACTTTCGCGAGATTCCTCGGCAAGGGCCCGCGCTTGCTC

CTCGGTGACCTGAGTTTGCTGTGCCATCGCCGCCTCCTCCCTGA

Clone Rv135
::::::::::::Rv135SP6.seq::::::::::::
TGCATCCGGCTCGTATGTTGTGTGGAATTGTGAGCGGATAACAATTTCACACAGGAAACAGCTATGACCATGATTACG (SEQ ID NO. 68)

CCAAGCTATTTAGGTGACACTATAGAATACTCAAGCTTTTACGGTGATCGCGCATCACCTGGTTCATGAACTGGAAGC

AGCGCAGCGCTTCCTTTTCGGCCGCAACATGAGCCAGCCTCTCGTCGGCGGTCGGGTGCAGGTGCTCGGGCAGCTCGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CCGCGACAGCCGCCTGACCCTGAAACCAGCTTCCATATCCCGCGACGAACGACGCCAGTCCGCTACGTAACCCCTCCG

CGACTGTCCATGGACAACAGCGCGTTCTCCACCGACCGGGCCCGGGTGTGGGGTGTTTCGGCGACCGGCAGCCAGGTG

GTCCACACTGCCGACGGGCGCCGCGAGCCGTTCACCGACCAGGCCGCCGAGCAAGTCCGCCCGATCGCATACTCC

::::::::::::Rv135T7.seq::::::::::::
GGGGGCGCTGCTGGTATAGTCGCTGACCGGTGCAGGTTTCGACAATGTGGTGCCGGTTCGGCGGCTACGTGCCATCGA (SEQ ID NO. 69)

GACACTGGCGCAGGCTATCGCACCCGTTATCGGCTACGAGCAAATCGCGGTATGCGTTCTTGAGCATGAGTCGGCGAC

CGTCGTCATGGTCGACACCCACGACGGAAAGACGCAGATCGCCGTCAAGCATGTGTGCCGCCGATTATCAGGACTGAC

CTCCTGGCTGACCGGCATGTTTGGTCGCGATGCCTGGCGCCCGGCCGGCGTGGTCGTGGTCGGCTCGGATAGCGAGGT

CAGCGAATTCTCGTGGCAGCTCGAAAGGGTCCTGCCGGTGCCGGTCTTTGCGCAAACGATGGCGCAGGTTACGGTCGC

GCGGGGTGCGGCCTGGCGGCGGCCAGAGCACGAGTTCACCGATGCGCAGCTAGTGGCGACAGCGTCAGCCAAC

Clone Rv136
::::::::::::Rv136SP6.seq::::::::::::
TGCTTCCGGCTCGTATGTTGTGTGGAATTGTGAGCGGATAACAATTTCACACAGGAAACAGCTATGACCATGATTACG (SEQ ID NO. 70)

CCAAGCTATTTAGGTGACACTATAGAATACTCAAGCTTCCGTACAGGTCGCCTCCAACACGGCGGGGAAGCGACACCA

GCCTACCGAGCTTGGAGTCCAGGACGCCAGCGGCGGCGTCGGTCTGCGTCGTGGTGCCGCCGGGGTGGCGTTGGCTGG

CAACGATCTCCACCCAGCCGGTCGGGTTACCCACGATCTCGGCATAGACGCGGGCCGAGGCCGGTGCGATACCGTATT

GCGTCAATTGGGACGCGGTTGTGCATTCGGCTAGCTCGGTTGCCACACCCGTCAGGGGTTCGACGTTGGCGGGTTCGG

CGGGCCCCAGCACCGCTGTCACCATGCCCGCCAAGCCGACCTGCGGCGCCACCAACT

::::::::::::Rv136T7.seq::::::::::::
CGGCATGACCACCGACAGGCCCGACTGGTCGTACCACTCGAACGCCGGGGTGTTGATGTCCCAGCCGCTGAAGTCGTC (SEQ ID NO. 71)

CTGCGCGCGCAGGCCGTCGAGCAGGTACAGGGCGGGCGAGTTGGCACCACCACTTTGGAATTGGACCTTGATGTCACG

GCCCATCGACGGCGACGGCACCTGCAGGTACTCCACCGGCAAGCCCGGCCGGGAAAATGCCCCCGCGGTCGCCGTGCC

ACCGACGGCGCCGACCAGACCCGACACTAGGGCCGCGCCGACGGCCCCGACCACGAGTCGACGCGACATACCCGTGAC

GGCGCCACGAACCCTGTCAACAAGCTGCATTCTTGCTTCCCTCATCCTCATCTCAACGCATCCATGCATGTTTGGGCG

CATCCTGAATTANGTCAGACTGCAGGCGCTGGGCCGGCAGTGCTCGTGTATCAACCACAACTTCGGGCGT

Clone Rv137
::::::::::::Rv137SP6.seq::::::::::::
TTCCAACCCTAATTGGCTTTCGGCCCCATCCGTGAGGACGGGGTGCGGGTGCTCAACAACAACGTCGTCCGCGGGACA (SEQ ID NO. 72)

CACCTCTATGCTGCCGCCATGGACGCGGTCCAACGCAAGCAGCTGATCGAGCTACAACCCCGCGCGGAACGCTTCCGC

CGCGGGCGTGACCGCATCCCGTTGACCGGGCGGATCGCGGTGATCGTCGATGACGGCATCGCCACCGGAGCGACGGCC

AAGGCGGCGTGCCACGTCGCCCGGGCGCACGGTGCGGACAAGGTGGTGCTGGCGGTCCCGATCGGCCCAAACGACATC

GTGGCGAGATTCGCCGGGTACGCCGATGAGGTGGTGTGTCTGGCGACGCCGGCGTTGTTCTTCGCCCTCGGGCAGGGT

TACCGCAACTTCAC

::::::::::::Rv137T7.seq::::::::::::
CAGGCATGCAAGCTTTCCGCCGATACCCGCCATGTCGCGCACATCCAGGACTTCTGGGGGGATCCGCTGACAGCGGCG (SEQ ID NO. 73)

GGATCCCAAAGTGCGGATGATCGGGCCGCCTACGTCGTGGTGTACCTCGTCGGTAACAACGAAACCGAAGCGTATGAC

TCGGTCCACGCGGTGCGGCACATGGTGGACACCACACCGCCACCGCACGGGGTGAAGGCCTATGTCACCGGTCCGGCA

GCACTCAATGCCGACCAGGCCGAGGCCGGAGACAAAAGTATCGCTAAGGTCACCGCCGATCACNAGCATGGTGATCGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

AGCAATGTTGCTAGTGATCTATCGCTCCGTAATTACCGCGGTTCTCGTCTTGATCATGGTCGGCATCGACTCGGCCAA

TCCGCGGATTCATCGCCTTGCTCGCCGAACACAACATTTTCACCTTTCACATTTGCACCAACCTGCTCTTCTCAT

Clone Rv138
::::::::::::Rv138SP6.seq::::::::::::
CACTACTCAAGCTCTCTCNTCATTACCACCCCTGTAATTTGGGATGGGCAAAAAGGCGAAGCACCGCTTGGCCACNAA (SEQ ID NO. 74)

CGCCGGGAGGGACAATCTCGGGCGGCTATGGCTTCTCCCGGGAAGGCCCCAACGTACGGCGTTTCAACACGTCGCGTC

GCCCTCCGACCGCGAACATTCGGGGATTGGCACCAACCTGNTACCACCCTGGCCGGGCGATGATCTGCAGCGTCGCCG

CGGGTAGTCCCCGCCCGGGCGGCTACAGTCTGAAACCCCGATGACCATCGATGTGTGGATGCAGCATCCGACGCAACG

GTTCCTACACGGCGGATATGTTCTCCTCGCTGCGCCGGTGGACCGGTGGGTCTATCCCCTGAAACCGACATCCCN

::::::::::::Rv138T7.seq::::::::::::
CAGGCATGCAAGCTTTCGTCAGTTCATTGCGCCAGCAGACCAACAAGAGCATCGGGACATACGGAGTCAACTACCCGG (SEQ ID NO. 75)

CCAACGGTGATTTCTTGGCCGCCGCTGACGGCGCGAACGACGCCAGCGACCACATTCAGCAGATGGCCAGCGCGTGCC

GGGCCACGAGGTTGGTGCTCGGCGGCTACTCCCAGGGTGCGGCCGTGATCGACATCGTCACCGCCGCACCACTGCCCG

GCCTCGGGTTCACGCAGCCGTTGCCGCCCGCAGCGGACGATCACATCGCCGCGATCGCCCTGTTCGGGAATCCCTCGG

GCCGCGCTGGCGGGCTGATGAGCGCCCTGACCCCTCAATTCGGGTCCAAGAACATCAACCTCTGCAACAACGGCGACC

CATTTGTTCGGACGGCAACCGGTGGCAACGCACCTAAGCTACTTGCCCGGGATGA

Clone Rv139
::::::::::::Rv139SP6.seq::::::::::::
GTTTATGCACTGGTTAGGTGTTTCCATGAGTTTCATTCTGAACATCCTTTAATCATTGCTTTGCGTTTTTTTATTAAA (SEQ ID NO. 76)

TCTTGCAATTTACTGCAAAGCAACAACAAAATCGCAAAGTCATCAAAAAACCGCAAAGTTGTTTAAAATAAGAGCAAC

ACGTACACAAGGAGATAAGAAGAGCACATACCTCAGTCACTTATTATCACTAGCGCCCGCCGCAGCCGTGTAACCGAG

CATAGCGAGCGAACTGGCGAGGAAGCAAAGAAGAACTGTTCTGTCAGATAGCTCTTACGCTCAGCGCAAGAAGAAATA

TCCACCGTGGGGAAAAACTCCAGGTAGAGGTAC

Clone Rv13
::::::::::::Rv13SP6.seq::::::::::::
ATACTCAAGCTTGGGTGTAGCCGATCACCGGAAGTCNCATGATCAGCCACGTTCCGCGCCGCCCGGCATACGGTGGTG (SEQ ID NO. 77)

TACCGATCTCCGCGTCATACACCCGCGGGTAATCGCCGACGGTGCCGGTTCGCGAGCCGAA

::::::::::::Rv13T7.seq::::::::::::
AGCTTTATCGAAAGCGCGAACAGCTCGCGGCGGCCCACGACGTGCTGCGTCGGATTGCCGGCGGCGAGATCAATTCCA (SEQ ID NO. 78)

GGCAGCTCCCGGACAATGCGGCTCTGCTGGCCCGCAACGAAGGACTCGAGGTCACCCCGGTGCCCGGGGTCGTGGTGC

ACCTGCCGATCGCACAGGTTGGCCCACAACCGGCCGCTTGATGCCCGGTCGGCAAGCCCGGCAGTTGCCAAACCCATC

GTGATCAGGCTCGGCTCGCGAGTTCGGCGAAGAAATGGTTCGCCTGATCACCTACCATCGGCCA

Clone Rv140
::::::::::::Rv140SP6.seq::::::::::::
TCAACACGCCGCCAGCCACCACGCGCGGGTCGGGCGCCGGGCCCGGGCCTCCAGGCTNCTCCGCTCGGTGATGGCACC (SEQ ID NO. 79)

CCACCGCGACACCACCCGGCTGCGCTACGTCGAGCCATACCGGGCGGAGCTACATCGGCCCGGCCGCCCAGTGTTCGG

GCCCTCTCGCCCAGGTCGAGGTCGACACCGATTTGCGCATCCGCAGCCGCACCCTGCGACGACAGAACCGCGGCCCTA

CCCACTGCTTGTCGGGCGGGGGCCAAAGAACCAGCTTGNCATCCTGCCACAATTGGCCGGCGCCCG

::::::::::::Rv140T7.seq::::::::::::
CAGGCATGCAAGCTTCACGTCCGTACGGCTCGGGTACGCTTCGGTCGCAGTGTGCGAGTGATAGATGACGACCGGGAC (SEQ ID NO. 80)

CTCGTCGGCATCTTCCATAGCCCGCCACACCTTCAGTTGCTCACCGGAATCCAACCGGTAGAAGGTCGGCCAGCGCTC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGCATTGGTCATCGGGATATGCCGCTCGGGACGGTCAGAGCCCTCGGGTCCGGCCAGCACTCCGCAGGCTTCGTCGGG

GTGGTCGCGACGCGCATGGGCCACCATCGCATTCACCAGGTCTGCGCGAATCACCAGCACGTAGACGGTTCCTTTCCT

AAGCAACAC

Clone Rv141
::::::::::::Rv141SP6.seq::::::::::::
AATATTCAAGCTTTCGGCGGAAACGGACNCCTTGCGAACATTGATAACAAAATAGAAATCATTGATGGTTTGAGTCAC (SEQ ID NO. 81)

CAGGCCGATCAAGCCTTCGCCGAGCCAAATTCCAATCAAGAGGCCCAAGCCCGTACCAATCAGCCCGGCAACGAGGGA

TTCCGTCNTTATCAGCCNAAATAACTGCTCTCGGGTACCACCCAAACAGCGCAATATGGCGAAAAACGGTCGCCGTTG

CACAACATTAAATGTCTCGGTATTGTTGATTAAAAAGATACCCACCACCAGGGCAATCCAACTGAGAGCGGTTAAATT

GACCGTAAAAACCTCCCGTCATCTGTTT

::::::::::::Rv141T7.seq::::::::::::
CAGGCATGCAAGCTTGCTGCATCTTCCTGTGACTGCTCCCGAAACCTGGGGGTGTGCCTGCTGTGTATGCACGGCATA (SEQ ID NO. 82)

CGGACATCCTTCCCCTGATACCCGCGGTCGAACCAGCCACGTGTCCATCATCAGGGGTCAACCCCGGCCAAGGGCGAC

GGCACGCCAAGTTCGCCGACCGTTAACCTAGTGCTGTTAGCTTCATTTGCTGCGAGCAAAACAGCTGGTCGGCCGTTA

GGAACTGAATTGAAACTCAACCGATTTGGTGCCGCCGTAAGTGTCCTGTCTGCGGGTGCGCTGGTGTTGTCCGCGTGT

GGTAACGACGACAATGTGACCGGGGGAGGTGCAACCACTGGCCAGGCGTCCGCGAAAGTCCATTGCNGGGGGAAGAAG

ACAC

Clone Rv142
::::::::::::Rv142IS1081.seq::::::::::::
GAAAGTGCCCCAAGGTGTTGGTGAAACTCGCTGGACGGTCCCCAGGATGTTGGCAGCACATTCACCGGACATGACCGG (SEQ ID NO. 83)

AGCAAGACCGGACATCCTCCCATACCGTCGTCGCCGTGTACATCCGTAGCCCGTCCTGGCAGGTGCTGGGTTGAACAA

AATCAGCCCAACACCTGCCACGACGAAGAAGCGGGTTGCGCTGGCATGTCTTGTCGGCTCGGCGATCGAATTCTACGA

ATTCCTTATCTACGGGACCGCTGCGGCGCTGGTGTTTCCCACCGTGTTCTTCCCACACCTGGATCCCACGGTGGCCGC

CGTGGCCTCCAAGGGGACATTTGCTGTGGCGTTCCTATCCCGGCCGTTCGGCGCGGCCGTCTTTGGATACTTTGGAGA

CCGCCTCGGCCGCCAGAAGACCCTGGTCGCCACACTGTTGATCATGGGCCTGGCAACCGTGACTGTTGGGCTGGTTCC

ACGACAGTGGCCATCGCGC

::::::::::::Rv142SP6.seq::::::::::::
ATATTCAAGCTTTGTCACACCAAGTGTTCCGACCAANCGCTCCATCCGGCGAGTGGATACTCCCAGCAGGTAGCAGGT (SEQ ID NO. 84)

CGCCACCACGCTGGTCAGTGCGCGTTCATCTCGCTTGCGGCGCTGCAGCAGCCAGTCCGGGAAATAGCTGCCCTGGCG

CAGCTTGGGGATCGCGACGTCGATGGTTGCGGCACGGGTGTCGAAATCACGGTGGCGGTAGCCGTTGCGCTGATTGGA

CCGCTCATCGCTGCGTTCGCGGTAGCCCNCCCCGCACAGGGCGTCGGCTTCAGCCCCCATCCAAGGCGGCGATGAACG

TCGAGAGCAGCCCGCGCAGCAAATCCGGGCTCGCCTGTGCGAGTTGGTCAGCCAGAAGCTGCTCGGTGTCATAAGATG

AGAAGAGGTCAGTGCGTCCTTTCCTTCG

::::::::::::Rv142T7.seq::::::::::::
CAGGCATGCAAGCTTTTTGAGCGTCTCGCGGGGCAGCTTCGCCGGCAATTCTACTAGCGAGAAGTCTGGCCCGATACG (SEQ ID NO. 85)

GATCTGACCGAAGTCGCTGCGGTGCAGCCCACCCTCATTGGCGATGGCGCCGACGATGGCGCCTGGACCGATCTTGTG

CCGCTTGCCGACGGCGACGCGGTAGGTGGTCAAGTCCGGTCTACGCTTGGGCCTTTGCGGACGGTCCCGACGCTGGTC

GCGGTTGCGCCGCCAAAGCGGCGGGTCGGGTGCCATCATGAATGCCTCACCGCCGCCGCACTGCACGGCCAGTGCCCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGCGATGTCAGCCATCGGGACATCATGCTCGCGTTCATACTCCTCGACCAGTCCGCGGAACAGCTCCATTCCCGGACC

GCCCAACGC

Clone Rv143
::::::::::::Rv143SP6.seq::::::::::::
ATACTCAAGCTTTTGGCTGGGTCGCCTTCCAATTCAGCGTGCACCGCTATGGGTTGCAGCAGCGGCTGGCNCCGCACA (SEQ ID NO. 86)

CCCCACTGGCCCGGGTGTTTTCGCCCCGAACCCGGATCATGGTGAGCGAAAAGGAGATTCNCCTGTTCGATGCTGGGA

TTCGCCACCGCGAGGCCATCGACCGATTACTCGCCACCGGGGTGCGAGAGGTGCCGCAGTCCCGCTCCGTCGACGTCT

CCGACGATCCATCCGGCTTCCGCCGTCGGGTGGCGGTAGCCGTCGATGAAATCGCTGCCGGCCGCTACCACAAGGTGA

TTCTGTCCCGTTGTGTCCAAGTGCCTTTCGCGATCGACTTTCCGTTGACCTACCGGCTGGGGCGTCGGCACAACACCC

CGGTGAGGTCGTTTTTGTTGCAGTTGGGCGGAATCCGTGCTCTGGGTTACAGCCCCGAACTCGTCACGGCGGTGCGCC

GCCGAC

::::::::::::Rv143T7.seq::::::::::::
CAGGCATGCAAGCTTCAACCTATTGACGCATTGTGCGAACTGACGGCGCCCGCGCATGGCCAATCCGGAAGACCATCA (SEQ ID NO. 87)

TTGGCCAGTGGCCGGGCGCTAACAGGTTCCAGCCCCCCACCAGTGCCGCTCGAACATGCGGTGCAACCCATTCGCAGG

CCGGCAGGGAAAGCACCGCGGAAGCCGCAAAGGGCTGCAGTTCCGCGCCCAATAGTGTCGTCCGCAACCAGATGCGCT

CGAAAACCGCCGCCGGCAGTCAGCGCACCCGACGCGAGGTCGAGAGACGTCGTCAGCGCGCCCACATGGGGTGCCAAT

CGGCACGGCAGGTAGGCCGCGCGCAACCCCAACGCGTGGTGCATGCCACGGTCCGCAGGAGGCCACCACCC

Clone Rv144
::::::::::::Rv144SP6.seq::::::::::::
ATACTCAAGCTTCCCGGCCGCAGGTGACGGCGCGGCCTAGCGCCACTTGATGCCGCACCCGATCGACGGNCGTTGGTC (SEQ ID NO. 88)

GGGGTTGACTGGCCGCCCGGCGAGCAGGGCGTCAACCGCGGCCCGGACGTCGGCGGCCGTCACCGGTCGGCCATTGCC

CGGGCGGGAGTCGTCGAGCTGACCACGGTAGACAAGTCGGCGCTGGCCGTCGAAGACAAACGTGTCGGGTGTGCAGGC

CGCGGAGAAGGCGCNGGCGACGTCTCGGGTTTCGTCGTAGAGATACGGGAACGTCCAGCCGTGGCGGCGGGCCTCGGC

GACCATCTGATCGGGCCCGTCCTGCGGGTAGGTGACCACGTCCTTACTGGAGATACCGACCATCGGGACCCTTTGATC

GGCGAGGTCCCGGCCGACCGTGGCCAATCCGGCGGCGACGTGTCGCCCGTACCGGCCAGTGGTTC

::::::::::::Rv144T7.seq::::::::::::
CAGGCATGCAAGCTTTANCANCATCAACCCCGCCCCGCACCAGCACCGACACGATGTCGATGCCATCGAGGTGAATGT (SEQ ID NO. 89)

CGAACTGGCNCAAACCATCTGGCGACCGCGACCACCGGCAACATGGGTACCGGCGATTTCCGGTGCCAATGCCGACCC

GACGGGCCGCTCTCACCGCAGGTGACCTCGATCACCGAGACCAGCCGGCCGTTATACTCACGCACCCCTACCGTGTCA

CGCCCAAAACGGCGCTGGTGGTCGATTGCCGGAGTGCACCCCGCACCCAGTGTCGTGCCCGGATCCGCCGACCAATCC

CGCACCCACGTCGCCAAACCCGAAATCACCGTGATGCCGTGGTAACTGACCACCGACAGTAACGTCACTACGGCCGCC

ACGCCGACGCCGAACCACCACGCACATGATGATCGGCTG

Clone Rv145
::::::::::::Rv145SP6.seq::::::::::::
ATATTCAACCTTGCACACATTGACGATACCTTGGTCACGAGACCCCAAAAGCTGGCCTCCACCGCGCGCCGGGGACCA (SEQ ID NO. 90)

CGGTCATACCTTGANNCNGCTTTCGATCGTTGATGCTGCGTCTTGGTCCGCGGAAACCGCAGGCTGGCATATGCACGT

GGGCGCACTGGCGATCTGCGATCCCCACCGATTCGCCCGAATACAGCTTTCAGCGGCTCCCCAAGTTGATCATCGACC

GGCTGCCGGATATCCCGCACTTGCGGTGGCGGGTCACCGGCGCCCCGCTCGGACTGGACCGGCCGTGGTTCGTCGAGG

ACCACGAAC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv145T7.seq::::::::::::
CAGGCATGCAAGCTTCATGCCCGCGGCATGATAGCCACATGCACGCAATCGAACTCAGCGAAACCGGCGGGCCAGGCG (SEQ ID NO. 91)

TCTTACGCCACCTCACCAGCGCGCAACCTCAACCCGGCCACGGAGACCTCCTGATC

Clone Rv146
::::::::::::Rv146SP6.seq::::::::::::
ATACTCAAGCTTGATTTTGATCATCATGATGATCATCACCCGAATTGTGGTAGCCGCAGTGGTTATCGTGGGTACCGT (SEQ ID NO. 92)

CGTGCTTTCCATGGGCGCCTCTTTCGGGCTTTCCGTATTGGTCTGGCAGGACATTCTGGGTATCGAGTTGTACTGGAT

GGTGTTGGCGATGTCGGTGATCCTGCTCNTGGCGGTGGGATCCGACTACAATCTGCTGCTGATTTCCCGGTTGAAAGA

GGAAATTGGGGCCGGATTGAACACCGGAATTATCCGTGCCATGGCTGGTACCGGGGGAGTGGTGACGGCTGCCGGCAT

GGTGTTCGCCGTTACCATGTCGTTGTTTGTGTTCAGCGATTTGCGAATTATTGGTCAGATCGGTACCACCATCGGCCT

GGGCTTGCTGTTCGACACCCTCGTCGTGCCTCGTTCATGAAACCGTCCATTGCTGCCCTGCTGGGACCTGGTTCTGGT

GGCCGCTACGGGTGCGCCCGCGCCCGGCAGTCAAATCTTCCGCCG

::::::::::::Rv146T7.seq::::::::::::
CAGGCATGCAAGCTTGGCGTGCCGTTCCAACCCGAATTGGCTTTCGGCGCCATCGGTGAGGACGGCGTGCGGGTGCTC (SEQ ID NO. 93)

AACGACGACGTCGTCCGCGGGACACACCTCGATGCTGCCGCCATGGACGCGGTCGAACGCAAGCAGCTGATCGAGCTA

CAACGCCGCGCGGAACGCTTCCGCCGCGGGCGTGACCGCATCCCGTTGACCGGGCGGATCGCGGTGATCGTCGATGAC

GGCATCGCCACCGGAGCGACGGCCAAGGCGGCGTGCCAGGTCGCCCGGGCGCACGGTGCGGACAACGTGGTGCTGGCG

GTCCCCATCGGCCCAGACGACATCGTGGCGAGA

Clone Rv147
::::::::::::Rv147SP6.seq::::::::::::
ATACTCAAGCTTTTACGGTGATCGCGCATCACCTGGTTCATGAACTGGAAGCAGCGCAGCCCTTCCTTTTCGGCCGCA (SEQ ID NO. 94)

ACATGAGCCAGCCTCTCGTCGGCGGTCGGGTGCAGGTGCTCGGGCAGCTCGGCCGCGACAGCCGCCTGACCCTGAAAC

CAGCTTCCATATCCCGCGACGAACGACGCCAGTCCGCTACGTAACCCCTCCGCGACTGTCCATGGACAACAGCGCGTT

CTCCACCGACCGGGCCCGGGTGTGGGGTGTTTCGGCGACCGGCAGCCANGTGGTCCACACTGCCGAAG

::::::::::::Rv147T7.seq::::::::::::
TAGTCGCTGACCGGTGCAGGTTTCGACNATGTGGTGCCGGTTCGGCGGCTACGTGCCATCGAGACACTGGCGCAGGCT (SEQ ID NO. 95)

ATCGCACCCGTTATCGGCTACGAGCAAATCGCGGTATGCGTTCTTGAGCATGAGTCGGCGACCGTCGTCATGGTCGAC

ACCCACGACGGAAAGACGCAGATCGCCGTCTANCNTGTGTGCCGCGGATTATCAGGACTGACCTCCTGGCTGACCGGC

ATGTTTGGTCGCGATGCCTGGCGCCCGGCCGGCGTGGTCGTGGTCGGCTCGG

Clone Rv148
::::::::::::Rv148SP6.seq::::::::::::
ATACTCAAGCTTTCCGCCGATACCCGCCATGTCGCGCACATCCAGAACTTCTGGGGGGATCCGCTGACAGCGGCGGGA (SEQ ID NO. 96)

TCCCAAAGTGCGGATGATCGGGCCGCCTACGTCGTGGTGTACCTCGTCGGTAACAACGAAACCGAAGCGTATGACTCG

GTCCACGCGGTGCGGCACATGGTGGACACCACACCGCCACCGCACGGGGTGAAGGCCTATGTCACCGGTCCGGCAGCA

CTCAATGCCGACCAGGCCGAGGCCGGAGACAAAAGTATCGCTAAGGTCACCGCGATCACGAGCATGGTGATCGCAGCA

ATGTTGCTAGTGATCTATCGCCCCGTAATTACCGCGGTTCTCGTCTTGATCATGGTCGGCATCGACCTCGGCGCAATC

CGCGGATTCNTCGCCTTGCTCGCCGACCACAACATTTTCAGCCTTTCAACATTTGCGACAACCTGCTCGTTCTCATGG

CGATTGCNGCGAAC

::::::::::::Rv148T7.seq::::::::::::
CAGGCATGCAAGCTTGGCGTGCCGTTCCAACCCGAATTGGCTTTCGGCGCCATCGGTGAGGACGGCGTGCGGGTGCTC (SEQ ID NO. 97)

AACGACGACGTCGTCCGCTGGACACACCTCGATGCTGCCGCCATGGACGCGGTCGAACGCAAGCAGCTGATCGAGCTA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAACGCCGCGCGGAACGCTTCCGCCGCGGGCGTGACCGCATCCCGTTGACCGGGCGGATCGCGGTGATCGTCGATGAC

GGCATCGCCACCGGAGCGACGGCCAAGGCGGCGTGCCAGGTCGCCCGGGCGCACGGTGCGGACAAGGTGGTGCTGGCG

GTCCCGATCGGCCCAGACGACATCGTGGCGAGATTCGCCGGGTACGCCGATGAAGTGGTGTTGTTTGGCGACCCGGCG

TTGTT

Clone Rv149
::::::::::::Rv149SP6.seq::::::::::::
ATACTCAAGCTTTGGCATTGTGCACATTTTCCACCCGTGCTCTATTAATGCTGAGCCGCTAATTGTGACCCCAGTCGG (SEQ ID NO. 98)

GAAACACGCGGAGCACCAAATTCACCGCAGCGGCCGGGGCGGTTCAACTCACCATGGATCGCTCTCGTCGTCTGGTGC

TGGACAATCGTCGCTGTAGCGCGTCGCGAACACCTCAGCTTCTGCTGCCGCGGCTTCTTCCGGCGATGGTAACCCCCA

GGTTTCGCCCACGGTCTTACGTAGCAGTGCGACGCGGTGTTCATCTGCATCGACCTGTTGACTCATCCTGTCAAGGAT

GAAGGCGTACTGGGCCGACTGCGCCTTCTGCCGCGCCAGGTCGGCAATCACCAGGATCTCAGAAACGAGCTGCGACTC

ACTCTTCCAGGCCACCCTGGCCGAAAGCTCGACATGGTCAATCCGGCCG

::::::::::::Rv149T7.seq::::::::::::
CAGGCATGCAAGCTTGCGGGCCGGAGTGGTTTCGACGGCCGCTCGCTTCTCGGCATCGGTTTGGGCTGTCACCAGCAG (SEQ ID NO. 99)

TTGGTAGTTCTTCACGTACTGTTGTTCGAGCGTCGAGCCGCCGCGCGTGTCGAGGTCGCCGGACGCGTATCCCGCCAG

GCCGGTCAGGGTGCCCTTCCAGTCCACGCCGCTGTGGTCGGCGAACCGCTTATCTTCAATCGAGACGATCGCCAGCTT

CATCGTGTTGGCGATCTTGTCCGAGGGCACCTCGAACCGGCGCTGCGAGTACAGCCACGCGATCGTGTTGCCCTTCGC

GTCGACCATCGTCGATACCGCAGGCACTTGCCCCTC

Clone Rv14
::::::::::::Rv14SP6.seq::::::::::::
ATACTCAAGCTTCCCGGCGGCCAGTACCGAAAGCGCGAACAGCTCGCGGCAGCCCACGACGTGCTGCGTCGGATTGCC (SEQ ID NO. 100)

GGCGGCGAAATCAATTCCAGGCAGCTCCCGGACAATGCGGCTCTGCTGGCCCGCAACGAAGGACTCGAGGTCACCCCG

GTGCCCGGGGTCGTGGTGCACCTGCCGATCGCACAGGTTGGCCCACAACCGGCCGCTTGATGCCCGGTCGGCAAGCCC

GGCAGTTGCCAAACCCAGCGTGATCAGGCTCGGCTCGCGAGTTCGGCGAAGAAGTGGCTCGCCTGATCACCTACCATC

GGCCAGGATCTGCGTGTCATCACAACGCTCGCCAAGGAGGTTGTTGTGGTGCTATCGACGGCCTTTAGCCAGATGTTC

GGAATCGACTATCCGATAGTGTCCGCGCCAATGGACTTGATCGCCG

::::::::::::Rv14T7.seq::::::::::::
AGCTTCGGTGTAGCCGATCACCGGAAGCCGCATGATCAGCCACGTTTCGCGCCGCCCGGCATACGGCGGCGTACCGAT (SEQ ID NO. 101)

CTCCGCGTCATACACCCGCGGGTAATCGCCGACGGTGCCGGTTCGCGAGCCGAAGGTGACGACGCTGATTGAATCGAG

TTCCAGGTCCAGCGGGTGGCGCAGCAACGGCGCGAGCTCAACGACGTCAATCACGTTGTCGCTTTCTACGGTCACCGA

CCCGGTGACCGTAGTCGCCCGGTGCGCTCGGCCGAGAAGTTGCACCGCCACCACCGCGACACCGTCTTGCACGCGGAC

GCCACCCCCGGATCGGTTGTTGGCCAAGGTAATTGGGTCATTCCATTTGACGGGACGCCGACCCCGCAGCCCCAGTAC

CGCCCACGACCACGCCGGCTGACCCACCACTGTACGAACACCAAGGCGACGCCGA

Clone Rv15
::::::::::::Rv150SP6.seq::::::::::::
ATACTCAAGCTTCGGTGGCTTCGCCCGCCCTGCCGGGTGGACTTCATGACAACGCGGGGGCGATTACCCCCGCTACCG (SEQ ID NO. 102)

CCAGCAGCATGACGGCGGTACCTAACACCGCCCGGATGCCTCGCACGTGCCTCGATGTGCTCACGGAATCGCCCCGGC

ACCGCGATCTCGAGGATCACCAGCGTTACCCCCGGCAGCGCGACACCGACAATTCCGTACACCGCCACGCCGATCCGG

CCCTGGGCCAGCTGATTGGAGCTGGCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv150T7.seq::::::::::::
CAGGCATGCAAGCTTCCACATGTACGGATCCACGAACATCCCGTTGAACTGACAGGTGCGGCCCGGCTCGATCAGGCC (SEQ ID NO. 103)

GGCCACTTGTTCTACGCGGTTACCGAAGATCTCTTCGGTGACCTGCCCGCCGCCGGCCAGCTCGGCCCAGTGCCCGGC

GTTGGCCGCCGCGGCGACGATCTTGGCGTCCACGGTGGTCCGGGTCTTGCCCGCTAGCACGATCCGCGAGTCGGCCGG

TCACCCGGGT

Clone Rv151
::::::::::::Rv151SP6.seq::::::::::::
ATACTCAAGCTTTCCAAGTCCCAAGTGTCGATCATGGCCAAAGAGCTCGACAAAGCCGTAGAGGCGTTTCGGACCCGC (SEQ ID NO. 104)

CCGCTCGATGCCGGCCCGTATACCTTCCTCGCCGCCGACGCCCTGGTGCTCAAGGTGCGCGAGGCAGGCCGCGTCGTC

GGGGTGCACACCTTGATCGCCACCGGCGTCAACGCCGAGGGCTACCGAAAGATCCTGGGCATCCAGGTCACCTCCGCC

GAAGACGGGGCCGGCTGGCTGGCGTTCTTCCGCGACCTGGTCGCCCGCGGCCTGTCCGGGGTCGCGCTGGTCACCAGC

GACGCCCACGCCGGCCTGGTGGCCGCGATCGGGGCCACCCTGCCCGCAGCGGCCTGGCAGCGCT

::::::::::::Rv151T7.seq::::::::::::
CAGGCATGCAAGCTTCACACGTAGGCGCCGTCGATAAATGACTCCGCCGCGCTTCGCACATCCTCGTAGCGATCCTTG (SEQ ID NO. 105)

GCGAGCAGGTCAACCGGGCGCTGCCCGTCGAGGAGCCGGTTTTTGGCGTGCAGCCACTGGCCGACACCTCGGGGGGTA

AGCGAATCCGAGAGCAGGAGGACGAGGTCACGAAGCTGCGCCAGCCGGTCGTACCGCTCAGGGCGGATGTCGCCGGTC

CGCCACCCGCGTACCGCCCGATCGGACACCTGTATGACCGCGGCGACGTC

Clone Rv152
::::::::::::Rv152SP6.seq::::::::::::
CGCGGCGGCGCATTACCCCCGCTACCGTCAGCAGCTTGACGGCGGTAGCGAACACCGCCGGATGCAGCGCAGGTGCGT (SEQ ID NO. 106)

CTATGTGCACACGGAATCGCCCCGGCACCGCGATCTCGAGGATCACCAGTGCCCGCCCCCTG

::::::::::::Rv152T7.seq::::::::::::
GGGATCGAGGAACAGCGCGTTGAACTGATAGGTGCGGCCCGGCTCGAGCAGGCCGGCCATTTGTTCGATGCCGTTACC (SEQ ID NO. 107)

GAAGATCTCTTCGGTGACCTGCCCGCCGCCGGCCAGCTCGGCCCAGTGCCCGGCGTTGGCCGCCGGCGCGACGATCTT

GGCGTCCACGGTGGTCGGGGTCATGCCCGCGAGCAGGATCGGCGAGCGGCCGGTCAGCCGGGTGAACTTCGTCGAGAG

CTTGACCCTGCCGTCGGGGAGGCGAACCACGGTCGGTGCGTATCTCGACCAGGCCCGGGCAACCTCGGGGGTGGCGCC

GACGGTGAACAGGTTGCGCTGGCCACCGCGGGTAGCCGCCGGCACTATGCCGATGCCCAGGCCGCGGATCACCGGTGC

GGTCAGTCGGGTCAGGATGTCGCCCGGCCCCAGGTCGAAGATCCAGCGGGCGCCGGCCGCGTGGACACNGGTGATCTC

GTCCACCATCGACTTTCTGATCA

Clone Rv153
::::::::::::Rv153SP6.seq::::::::::::
TAACTCAAGGCTTGCGTTGAGGCCCCAGGCCCATCGACGGTTTGGCGGCCTTAAATGCACTGAGGTCGTCAATTGACC (SEQ ID NO. 108)

CCACAGCGGAAATGCCGACTATTCGCAGGCCTCCTTCGCCTTGGCTGCCGGAGAGGGGCTCCGCGGGAACCGCATGCA

GGTATATGACCTCGGTTTCTCGGGTGCTACCGCGTGCCTTGTCGAGGATGAACTCGGCGTTGGAATTGTCCAGCCGGC

CCAATTCATCGAGCGCAGATTCGTACACATGGCCGGCGGCGACATACGCTTCACCGTGGATCTGCTCCACACGGACCG

CCCTGTCGGGATCCTGCTCACGGGTAAAGGAACTTACNTGGCNCTCGGTGCC

::::::::::::Rv153T7.seq::::::::::::
CCTTCTGCGCCACCCACACCGTCAACGCCCGCGAAGTCGACGTCGTCCAGGCCATCGGCGGCCTCACGGATGGATTCG (SEQ ID NO. 109)

GCGCGGACGTGGTGATCGACGCCGTCGGCCGACCGGAAACCTACCAGCAGGCCTTCTACGCCCGCGATCTCGCCGGAA

CCGTTGTGCTGGTGGGTGTGCCGACGCCCGACATGCGCCTGGACATGCCGCTGGTCGACTTCTTCTCTCACGGCGGTG

CGCTGAAGTCGTCGTGGTACGGCGATTGCCTGCCCGAAAGCGACTTCCCCACGCTGATCGACCTTGACCTGCATGGCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGCTGCCGCTGCAGCGGTTCGTTTCCGAACGCATCGGGCTCGAAGACGTCGAGGAGGCGTTCCACAAGATCCATGGCG

GCAAGGTATTGCGTTCGGTGGTGATGTTGTGATGGCCGCCATCGAGCGCGTCATCACCCACGG

Clone Rv154
::::::::::::Rv154SP6.seq::::::::::::
ATACTCAAGCTTGATTTTGATCATCATGATGATCATCACCCGAAGTGTGGTAGCCGCAGTGGTTATCGTGGGTACCGT (SEQ ID NO. 110)

CGTGCTTTCCATGGGCGCCTCTTTCGGGCTTTCCGTATTGGTCTGGCAGGACATTCTGGGTATCGAGTTGTACTGGAT

GGTGTTGGCGATGTCGGTGATCCTGCTCCTGGCGGTGGGATCCGACTACAATCTGCTGCTGATTTCCCGGTTGAAAAA

AGAAATTGGGGCCGGATTGAACACCGGAATTATCCGTGCCATGGCTGGTACCGGGGGAGTGGTTACCGCTGCCGGCAT

GGTGTTCGCCGTTACCA

::::::::::::Rv154T7.seq::::::::::::
ATTGNCTTTCGGCGCCATCGGTGAGGACGGCGTGCGGGTGCTCAACGACGACGTCGTCCGCGGGACACACCTCGATGC (SEQ ID NO. 111)

TGCCGCCATGGACGCGGTCGAACGCAAGCAGCTGATCGAGCTACAACGCCGCGCGGAACGCTTCCGCCGCGGGCGTGA

CCGCATCCCGTTGACCGGGCGGATCGCGGTGATCGTCGATGACGGCATCGCCACCGGAGCGACGGCCAAGGCGGCGTG

CCAGGTCGCCCGGGCGCACGGTGCGGACAAGGTGGTGCTGGCGGTCCCGATCGGCCCAGACGACATCGTGGCCAGATT

CGCCGGGTACGCCGATGAGGTGGTGTGTTTGGCGACGCCGGCGTTGTTCTTCGCCGTCGGGCAGGGTTACCGCAACTT

CACCCAGACCTCCGACGAAGAAGTGGTGGCGTTTTCTGGATCGTGCTC

Clone Rv155
::::::::::::Rv155SP6.seq::::::::::::
ATACTCAAGCTTTTCCCGTCCGTCATCGCCCAAGCGCGTGAGGCCGAAGCGGCTGGTTACGACTCCCTGTTTGTGATG (SEQ ID NO. 112)

GACCACTTCTACCAACTGCCCATGTTGGGGACGCCCGACCAGCCGATGCTGGAGGCCTACACGGCCCTTGGTGCGCTG

GCCACGGCGACCGAGCGGCTGCAACTGGGCGCGTTCGTGACCGGCAATACCTACCGCAGCCCGACCCTGCTGGCAAAG

ATCATCACCACGCTCGACGTGGTTAGCGCCGGTCGAGCGATCCTCGGCATTGGAGCCGGTTGGTTTGAGCTGGAACAC

CGCCAGCTCGGCTTCGAGTTCGGCACTTTCAGTGACCGGTTCAACCGGCTCGAANAGGCGCTACAGATCCTCGAGCCA

ATGGTCAAGGGTGAGCGCCAACGTTTTTCGGCGATTGGTACCCACCGA

::::::::::::Rv155T7.seq::::::::::::
CGGCCACCGGGGCCACTCCGCACAATCTGTACCCGACCAAGATCTACACCATCGAATACGACGGCGTCGCCGACTTTC (SEQ ID NO. 113)

CGCGGTACCCGCTCAACTTTGTGTCGACCCTCAACGCCATTGCCGGCACCTACTACGTGCACTCCAACTACTTCATCC

TGACGCCGGAACAAATTGACGCAGCGGTTCCGCTGACCAATACGGTCGGTCCCACGATGACCCAGTACTACATCATTC

GCACGGAGAACCTGCCGCTGCTAGAGCCACTGCGATCGGTGCCGATCGTGGGGAACCCACTGGCGAACCTGGTTCAAC

CAAACTTGAAGGTGATTGTTAACCTGGGCTACGGCGACCCGGCCTATGGTTATTCGACCTCGCCGCCCAATGTTGCGA

CTCCGTTCGGGTTGTTCCCAGAGGTCAGCCCGGTCGTCATCGCCGACGCTCTCGTCGCCGGGACCAGCAGGGAATCGG

CGATTTCGCCTACA

Clone Rv156
::::::::::::Rv156SP6.seq::::::::::::
ATACTCAAGCTTGGGGTGGCGCTGTCGGTCGGTGTGCTTGGCGGCGTCGGTATCAACACCGCCCACGAAATGGGGCAC (SEQ ID NO. 114)

AAGAAGGATTCGCTGGAGCGGTGGCTGTCCAAAATCACCCTCGCCCAGACCTGCTACGGGCACTTCTACATCGAGCAC

AACCGTGGCCATCACNTCCGGGTGTCCACACCGGAGGACCCGGCGTCGGCGCGGTTCGGCGAAACGTTGTGGGAGTTC

CTGCCCCGCAGTGTTATCGGCGGCTTGCGCTCGGCCGTTCATTTGGAGGCCCAACGGCTGCGTCGGCTCGGCGTCAGC

CCCTGGAATCCCATGACGTATCTGCGCAACGACGTGCNCAACNCGTGGCTGATGTCNGTGGTGTTGTGGGGTGGGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv156T7.seq::::::::::::
TCGCCACCGCACCGCGGCGAACGCTCAAAGGCACCTACTGGCACCAAGGCCCCACACGTCACCCTGTGACCTCCTGCG (SEQ ID NO. 115)

CCGACCCCGCCCGAGGTCCTGGCCGTTACCACCGAACGGGCGAGCCGGGAGTCTGGTACGCATCGAACAAAGAGCAAG

GTGCATGGGCGGAGTTGTTCCGCCACTTCGTCGATGACGGGGTCGATCCATTCGAGGTCCGTCGCCGCGTCGGTCGAG

TGGCGGTCACACTCCAGGTACTCGACCTCACAGACGAGAGGACTCGATCCCATCTAGGTGTGGACGAAACAGATCTTC

TGTCCGACGACTACACCACCACCCAGGCCATCGCCGCCGCCCGCGATGCCAACTTCGACGCCGTACTGGCCCCGGCGC

CGGCGCTCCCCGGTTGTCAAACACTTTGCCGTGTTCGTTCACGCACTGCCCAACATCGAGCCCGA

Clone Rv157
::::::::::::Rv157SP6.seq::::::::::::
ATGAAATAAGAAGAGCACATCCCTCAGTCGGTTATCATCACTAGCGCTCGCCGCACCCGTGTAACCGATCATAGCGAG (SEQ ID NO. 116)

CGAACTGGCGAGGAAGCAAAGAATATCTGTTCTGTCAGATAGCTCTTACGCTCAGCGCAAGAAGAAATATCCCCCGCG

GGAACAACTCCAGGTAGAGGTACACACGCGGATAGCCAATTCAGAGTAATAAACTGTGACACTCACACCCTCATCAAT

GATGACGAACTACACCCCGATATCCGGTCACATGACGAAGGGAAAGAGAAGGATATCATCTGTGACAAACTGCCCTCA

AATTTGGCTTCCTTAA

Clone Rv159
::::::::::::Rv159SP6.seq::::::::::::
ATACTCAAGCTTGTCGAACTCCTTCTTGAATACCGGCCGGCCATCCACAGATGCCCGGAAGAACTTCCAGGTACCCAT (SEQ ID NO. 117)

GGCGGCTGGATCAGGGGGCGGCACAGTTGGTCTTGTCCTGCCTCGAGTGGCGTCGTTGTCCGGCTTGGACGGGGCTCC

GACGGTACCGGAGGGCAGCGACAAAACACTTATGCACTTGGGCGACCCGCCGAGACGGTGCGACACCCATCCCGACGG

CACAAGCTCAGCCGCGGCCGCTCTTGTTCTTCGTCGGATCGACATTCACCCACTTCTGACCGGGCTTGGGCGAAGGAA

GCAGAA

::::::::::::Rv159T7.seq::::::::::::
GGTATAGTCGCTGACCGGTGCAGGTTTCGACAATGTGGTGCCGGTTCGGCGGCTACGTGCCATCGAGACACTGGCGCA (SEQ ID NO. 118)

GGCTATCGCACCCGTTATCGGCTACGAGCAAATCGCGGTATGCGTTCTTGAGCATGAGTCGGCGACCGTCGTCATGGT

CGACACCCACGACGGAAAGACGCAGATCGCCGTCAAGCATGTGTGCCGCGGATTATCAGGACTGACCTCCTGGCTGAC

CGGCATGTTTGGTCGCGATGCCTGGCGCCCGGCCGGCGTGGTCGTGGTCGGCTCGGATAGCGAGGTCAGCGAATTCTC

GTGGCAGCTCGAAAGGGTCCTGCCGGTGCCGGTCTTTGCGCAAACGATGGCGCAGGTTACGGTCGCGCGGGGTGCGGC

CCTGGCGGCGGCCCA

Clone Rv15
::::::::::::Rv15SP6D2.seq::::::::::::
GACACTATATNATACTCAAGCTTCAGGTCAATGTGCGCCAAGCCCTGACGCTGGCCGACCAGGCCACCGCCGCCGGAN (SEQ ID NO. 119)

CCCTNTCTAGA

::::::::::::Rv15T7.seq::::::::::::
CTGTAGCCACCTGTTGCCATCCCCGTCATGCCCGACTCTGCTCATCTCGGATCCGCTGACACCCCGCTAAGGCTGCTC (SEQ ID NO. 120)

CTCTCGGTGCATTACCTCACCGACGGCGAACNCCCCCAGCTTTACGACTATCCGGATGACGGCACCTGGTTGCCGGCT

AACTTCACCGTCAGCTTGGACGGCGGCGCTACCGTCGATGGCGCCAGCGGGGCGATGGCCGGGCCCGGCGACCGATTC

GTCNTCANCCTGTCGCGTGAACTTGCCGACGTCATCGTGGTCGGTGTGGGCACCGTGCGCATTGAGGGCTACTCCGGC

GTCCGGATGGGTGTCGTCAAGCGCCCGCACCGGCAGGCCCGA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv160
:::::::::::::Rv160SP6.seq:::::::::::::
ATACTCAAGCTTCGCACGCTCGGCGCGCGCGGTACCGCCCAGGTCGCCCAACAGATCGTCGATGTTCGCGTCGTCCGC (SEQ ID NO. 121)

CTCGCGCACGTGGTCTGTCACCAGTCAACGTTAACGCCGCCGCACATGTCCTGCGGCCGGGCAAAAACGTGAAAAACG

AGCGGGCGACTGCNATGTCATGACACCGACGGCCGCCGATGGGCCCAGGGTCTGGCAAATTCGATCTGTGCGGCCAGT

GCCAGCAGCGTCGCCTCGTCATACGGCCGGCCGACGAGTTGAACCGACATGGGCAGGCCGTCGCCGTCGAAGTCCCAC

GGCACCACGGGCGCGGGCTGGCCGGTCAGATTCCAAAATTGAAAGTACGGAACCGCTGCACCACCAA

:::::::::::::Rv160T7.seq:::::::::::::
ATCGTTTCGACCAGGCGCTCCATCCGGCGAGTGGATACTCCCAGCAGGTAGCAGGTCGCCACCACGCTGGTCAGTGCG (SEQ ID NO. 122)

CGTTCAGCTCGCTTGCGGCGCTGCAGCAGCCAGTCCGGGAAATAGCTGCCCTGGCGCAGCTTGGGGATCGCGACGTCG

ATGGTTGCGGCACGGGTGTCGAAATCACGGTGGCGGTAGCCGTTGCGCTGATTGGACCGCTCATCGCTGCGTTCGCGG

TAGCCCGCCCCGCACAGGGCGTCGGCTTCAGCCCCCATCAAGGCGGCGATGAACGTCGAGAGCAGCCCGCGCAGCAGA

TCCGGGCTCGCCTGTGCGAGTTGGTCAGCCAGAAGCTGCTCGGTGTCGATAAGATGANAAGAAGTCATTGCGTTATTT

CCT

Clone Rv161
:::::::::::::Rv161SP6.seq:::::::::::::
ATACTCAAGCTTGGGTGTTGCCGATCACCGGAAGCCGCATGATCAGCCACGTTTCGCGCCGCCCGGCATACGGCGGCG (SEQ ID NO. 123)

TACCGATCTCCGCGTCATACACCCGCGGGTAATCGCCGACGGTGCCGGTTCGCGAGCCGAAGGTGACGACGCTGATTG

AATCGAGTTCCAGGTCCAGCGGGTGGCGCAGCAACGGCGCGAGCTCAACNACGTCAATCACGTTGTCGCTTTCTACGG

TCACCGACCCGGTGACCGTAGTCGCCCGGTGCGCTCGGCCGAGAAGTTGCACCGCCACCACCGCGACAACGTCTTGCA

CGCGGACGCCACCCCCCGGAT

:::::::::::::Rv161T7.seq:::::::::::::
GCGCNAACAGCTCGCGGCAGCCCACGACGTGCTGCGTCGGATTGCCGGCGGCGAGATCAATTCCAGGCAGCTCCCGGA (SEQ ID NO. 124)

CAATGCGGCTCTGCTGGCCCGCAACGAAGGACTCGAGGTCACCCCGGTGCCCGGGGTCGTGGTGCACCTGCCGATCGC

ACAGGTTGGCCCACAACCGGCCGCTTGATGCCCGGTCGGCAAGCCCGGCAGTTGCCAAACCCAGCGTGATCAGGCTCG

GCTCGCGAGTTCGGCGAAAAAGTGGCTCGCCTGATCACCTACCATCGGCCAGGATCTGCGTGTCATCACGACGCTCGC

CAAGGAGGTTGTTGTGGTGCTATCGACGGCCTTTAGCCAGATGTTCGGAATCGACTATCCGATAGTGTCCGCGCCAAT

GGACTTGATCGCCGGCGGTGAGCTGGCTGCCGCNGT

Clone Rv162
:::::::::::::Rv162SP6.seq:::::::::::::
ATACTCAAGCTTTCTCCGATACCCGCCATGTCGCGCACATCCAGGACTTCTGGGGGGATCCGCTGACAGCGGCGGGAT (SEQ ID NO. 125)

CCCAAAGTGCGGATGATCGGGCCGCCTACGTCGTGGTGTACCTCGTCGGTAACAACGAAACCGAAGCGTATGACTCGG

TCCACGCGGTGCGGCACATGGTGGACACCACACCGCCACCGCACGGGGTGAAGGCCTATGTCACCGGTCCGGCAGCAC

TCAATGCCGACCAGGCCGAGGCCGGAAACAAAAGTATCGCTAAGGTCACCGCGATCACGAACATGGTGATCGCAGCAA

TGTTGCTAGTGATCTATCGCTCCG

:::::::::::::Rv162T7.seq:::::::::::::
CCATGAGCACCGCCAGCCGAGCACGAGGCCAAACTCCGCCGACGCAGGCCGGTTGGACTTGTCGTGCTGGACAAGGGG (SEQ ID NO. 126)

TTTAGCCGCCGAAGCAGTGACGTACATCGGCGAAGAGCAGTTCGCCTGTCGACCGACGGCGCAAACCGTGAGGCTAGG

GAAGCGAGGAGCACATGGCCGCCGACCCGCAATGTACACGCTGCAAGCAAACCATCGAACCCGGATGGCTATACATCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CCGCCCATCGCCGCGGTCAAGCCGGGATCGTCGATGACGGCGCAGTACTGATTCACGTGCCCGGTGAATGCCGCACCC

CGGGGAGCACTTTCCGCCAAAACTAACCCGGTTGG

Clone Rv163
::::::::::::Rv163SP6.seq::::::::::::
CGGGTGTCATTGGCCACCGGCGGCGGCTGTCCGGGAAATGGCGGGTCCCCGGTGGTTTTGCTGAGGAGTGCTGAACCG (SEQ ID NO. 127)

TAGTCGAAGTGGGCGGCGTCAGACTCCACCCAGCCAGCAGGCAGCGCGAANCTGAATCCTCCAACCGGGTTGTCNATC

CGGACAGGTTGGGGTGCGTTTGGGGCAATNACAGGTGGCGGCGGTGCGTTCGGGTCGGCCGGCGGAGGTGCTGCNTTG

GGATCCCCGGCTGGGCATTCGGCNTGTTGGCGGCGGCCGGTGGTGGGGGGGGCAACACGTGTCNCCGGTGCGGGTGGC

CCT

::::::::::::Rv163T7.seq::::::::::::
CCAAGATCTACACCATCGAATACGACGGCGTCGCCGACTTTCCGCGGTACCCGCTCAACTTTGTGTCGACCCTCAACG (SEQ ID NO. 128)

CCATTGCCGGCACCTACTACGTGCACTCCAACTACTTCATCCTGACGCCGGAACAANTTGACGCAGCGGTTCCGCTGA

CCAATACGGTCGGTCCCACGATGACCCAGTACTACATCATTCGCACGGAGAACCTGCCGCTGCTAGAGCCACTGCGAT

CGGTGCCGATCGTGGGGANACCCACTGGCGAACCTGGGTTCAACCAAACTTGAAGGTGATTGTTAACCTGGGCTACGG

CGACCCGGCCTATGGTTATTCGACCTCGCCGCCCAAATGTTG

Clone Rv164
::::::::::::Rv164SP6.seq::::::::::::
AGCTTCCCGAGTTCGGCTTTGGATCAAGACCCCAGTCCGCGGGCGCGATCCGGCNGCTCGGTGACTACATCAAGCCAC (SEQ ID NO. 129)

AAATCGACGGCTTTCGGGGTGCCGATACCGATGACGTGGCGGATGTCGAGTGTTGAGTTCTCGGCGGGGCGGATGCTC

ACCTGGCGATCACCTGCCTCTCGTTGACGATCGATCGTCTATGCCGCCGTCTCTGCGGGAACAGGCCNCCAGTACATC

GCCACAGACGGGATCCACCCGCATTTCGGCTACGGTTGCTCGTTTCGGTGTTCGGACTAGTCGGTCCTGGTGACGTGC

CGGTGATGCGGACCGGTCCTAGCACTGACCAATGGCCAAAATGCGGGC

::::::::::::Rv164T7.seq::::::::::::
CGGGGGGCCTCTTAATAGTGTAGGAAAGAAGCTCTACATATTCAGGAGGATTCACCATGGCTCGTGCGGTCGGGATCG (SEQ ID NO. 130)

ACCTCGGGACCACCAACTCCGTCGTCTCGGTTCTGGAAGGTGGCGACCCGGTCGTCGTCGCCAACTCCGAGGGCTCCA

GGACCACCCCGTCAATTGTCGCGTTCGCCCGCAACGGTGAGGTGCTGGTCTGCCAGCCCGCCAAGAACCAGGCAGTGA

CCAACGTCGATCGCACCGTGCGCTCGGTCAAGCGACACATGGGCAGCGACTGGTCCATAGAGATTGACGGCAAGAAAT

ACACCGCGCCGGAGATCAGCGCCCGCATTCTGATGAAGCTGAAGCGCGACGCCGAGGCCTACCTCGGTGAGGACATTA

CCGACGCGGTTATCACGACGCCCGCCTACTTCAATGACGCCCAGCGTCAGGCCACCAAGGACCCGGCCAGATCGCCGG

TCTCACGTGCTGCGG

Clone Rv165
::::::::::::Rv165SP6.seq::::::::::::
ATACTCAAGCTTCATAACAGGCCTGTTGTGGGCGCACCCGGCTCGCCGAGTTCTGCACGCACCGCCTCAAGTGCGGCC (SEQ ID NO. 131)

CGCACCGCCGGCATCTCCCGGTCACGCAGGGCCGCGGCCCGCGCCGCAGCGACGGCGTGTTCGCGCAGTTCGCCGTCA

ATGATGCTGACCTGATCGGCCACCCGGGCGTTCTCGGCGTCTTCGCGTTCACTAATCGCGGTGCTCAGCAGCGTCTCG

ACAGCCACCACCCGAGTGGCGACCAGCTGCTCCACCACGGACCGCAGCGATGCCGTCACCTCACCCGTCCAGCGGTCC

ACCACGACACGGTCGTGCACCAGCGCGCGGGCATTCACCACCCAGGCGGTCACCGCCAGGCCGATCGCCACACCCGCC

ACCATCCCCGATGCAGCCAGGCCGGGAGTAAGA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv165T7.seq::::::::::::
CTGGTGCTGGACGGAGCCTAGTACAACTTCCTCTCCAATGCTCTTGCCCCGATCGCGGCGACCAGGATGACCCAGGAC (SEQ ID NO. 132)

ATCCTGCCGCCCGAAGTACTGGAAAAGCTCACACCCGAGTTCGTCGCACCGGTGGTGGCCTACCTGTGCACCGAGGAG

TGTGCCGACAACCCATCGGTGTACGTCGTCAGTGGTGGTTAGGTGCAGCGAGTTGCGCTGTTTGGCAACGACGGCGCC

AACTTCGACAAACCGCCGTCNGTACAAGATGTTGCGGCGCGGTGGGCCGAGATCNCCGATCTGTCCGGTGCGAAAATT

GCTGGATTCAAGTTGTAGAACTAAAT

Clone Rv166
::::::::::::Rv166SP6.seq::::::::::::
ATACTCAAGCTTTTCCGGCGTCGTCCACCTGACCCAAAAAGCGCAGGTGCGCCGCCAAACGGCCCGCCTGGCCGCGCA (SEQ ID NO. 133)

ACTGGTCGGCGTCGCCGTGGCCGACAATCAGTAGCTGGACATCCGGAAACCGCTGCACCACCTTCGGCAGCGCGTCAA

GCAAAAACGGCCATTCC

::::::::::::Rv166T7.seq::::::::::::
TTTCAGATCTCATTTTTATGACATGACTGGAGATCTGTCTAGATTGCAGCTCCTGTGAGCGTGGGTACCGGATTCAAG (SEQ ID NO. 134)

CCGGTCGGTCACGCCGCGGTGGTACCGGCTTTGCGGCAGTGCTCGGCCTCGAGTTCGGCGATCGCGCGCGAAGTGCGT

TTCGCGCACCAAGATCGCGGCCTAATGGCCGGCGATGACCGCGATGACCAGCGCGATCCAGGAAAAACCGTTCCAACC

AGTGCTGGGCGGCCATCCCCG

Clone Rv167
::::::::::::Rv167SP6.seq::::::::::::
ATACTCAAGCTTCCCGACCACAAGTTGAACAGCACCGATTTCGGCGAGCACTTCGTCAACTTCCAGGGTGCCCGCACC (SEQ ID NO. 135)

AAGTATTTCGACAAGTATTTCCGTCGGGCCGCCGCCGCCGGCGCGCGGCAGGTGGTCATCCTGGCGGCGGGGCTGGAC

TCCCGCGCGTACCGGCTGCCTTGGCCCGACGGGACCACGGTTTTTGAGCTGGACCGCCCGCAGGTCCTTGATTTCAAG

CGCGAGGTGCTCGCCAGCCACGGTGCCCAACCGCGCGCCCTGCGCCCGCGA

::::::::::::Rv167T7.seq::::::::::::
GTGTGCTGTCAATTCAGAGCTGAGCCTGATGCACTCAACTTACTGAGCATGCTAACGCTGGTCGTGCGGGTCTTGTTC (SEQ ID NO. 136)

CCGCGTGTCGGCAGGGCACACGCTCGGGGCGTAGCTGGGAGAGGCCCCGGTCAAGCCCGGAGAGCAGTGCTCAGTCCG

CCAGCTTGACCGACTTTCGATGAGAACGCGCTTCTCGCCGTATTGAACTGGCGTGCTGACGGTCGCTGAGCAGCGCTC

GCCGAGTGCGGCCGCTGATTCTTTCATCGAGCCAGGCGAGGCATTCGTGTTCGGCCGCCTGCGGGTCGCCCCCATCGT

CGACGCGATCCGTCACCCACTCCTCGATCAGGTCTGCCTCATCGAACGGGCCAACGGTGCTGTCGGACTATGTGTGCG

TGGGCACGGCGAGCCGGGTGCTGTGGTACACCCACCGTTGCATGACCAAGTTGACGCCTGACTGGCTGAGCACCGCGA

TCCGCTCACAGGTCGGAACGTTGGTG

Clone Rv169
::::::::::::Rv169SP6.seq::::::::::::
ATACTCAAGCTTTTGGTCTAGCCGGCCGAGCCCGATACAGGTGTCATTGGCCACCGGCGGCGGCTGTCCGGGAAATGG (SEQ ID NO. 137)

CGGGTCCCCGGTGGTTTTGCTGAGGAGTGCTGAACCGTATGCGAAGTGGGCGGCGTCAGACTCCACCCAGCCAGCAGG

CAGCGCGAAACTGAATCCTCCAACCGGGTTGTCGATCCGGACAGGTTGGGGTGCGTTTGGGGCAATGACAGGTGGCGG

CGGTGCGTCCGGGTCGGCCGGCGGAAGTGCTGCGTTGGGATCGCCCGGCTGGGCATTCTGCGTGTTGGCGGCGGCCGG

TGGTGGGGGGGCAACAGGTGTCTCCGGTGCGGGTGGCGCTGCACC

::::::::::::Rv169T7.seq::::::::::::
GGGGCCACTCCGCACAATCTGTACCCGACCAAGATCTACACCATCGAATACGACGGCGTCGCCGACTTTCCGCGGTAC (SEQ ID NO. 138)

CCGCTCAACTTTGTGTCGACCCTCAACGCCATTGCCGGCACCTACTACGTGCACTCCAACTACTTCATCCTGACGCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GAACAAATTGACGCAGCGGTTCCGCTGACCAATACGGTCGGTCCCACGATGACCCAGTACTACATCATTCGCACGGAG

AACCTGCCGCTGCTAGAGCCACTGCGATCGGTGCCGATCGTGGGGAACCCACTGGCGAACCTGGTTCAACCAAACTTG

AAGGTGATTGTTAACCTGGGCTACGGCGACCCGGCCTATGGTTATTCGACCTCGCCGCCCAATGTTGCGACTCCGTTC

GGGTTGTTCCCAGAGGTCAGCCCGGTCGTCATCGCCGACGCTCTCGTCGCCGGGACCCAGCACGGAAT

Clone Rv16
:::::::::::::Rv16SP6.seq:::::::::::::
TTCTNTCTTCCCNNATTCGTNNNTCTCNTACTACCNGGGCCNCAAAACACCTTGGCNAACGCTCAAAGGCGNTACNGG (SEQ ID NO. 139)

CACCAAGGCCCCACACGTCACCCTGTGACCTCCTGCGCCGACCCCGCCCGAGGTCCTGGCCGTTACCACTGAACGGGC

GAGCCGGGAGTCTGGTACGCATCGAACAAAGAGCAAGGTGCATGGGCGGAGTTGTTCCGCCNCTTTTTTTATGACGGG

GTCGATCCATTCGAGGTCCGTCGCCGCGTCGGTCGAGTGGCGGTCACACTCCAGGTACTCGACCTCNCAGACGAGAGG

ACTCGATCCCATCTANGTGTGGACNAAACAGATCTTCTGTCCGACGACTACACACCACCCAGGCCATCGCCGCCGCCC

GCGATGCCAACTTCNACNCCGTNCTGGCCCCGGCGGCGGCGCTCCCCGGTTGTCAAACACCTGCCGTGTTCGTTCACN

CACTGCCCAACATCNAGCCCGANCNATCCNAGGTCCGTCCAACGCCTCCGCGGCTCNCCAACCTNCTCCCNCTGATCN

TCCGCACCAAACACATGCCCGACTCCNTGCNCCNATTGCTTGNATCCCT

:::::::::::::Rv16T7.seq:::::::::::::
CCGCTATCGGTCGGTGTGCTTGGCGGCGTCGGTATCAACACCGCCCACGAAATGGGGCACAAGAAGGATTCGCTGGAG (SEQ ID NO. 140)

CGGTGGCTGTCCAAGATCACCCTCGCCCAGACCTGCTACGGGCACTTCTACATCGAGCACAACCGTGGCCATCACGTC

CGGGTGTCCACACCGGAGGACCCGGCGTCGGCGCGGTTCGGCGAGACGTTGTGGGAGTTCCTGCCCCGCAGTGTTATC

GGCGGCTTGCGCTCGGCCGTTCATTTGGAGGCCCAACGGCTGCGTCGGCTCGGCGTCAGCCCCTGGAATCCCATGACG

TATCTGCGCAACGACGTGCTCAACGCGTGGCTGATGTCGGTGGTGTTGTGGGGTGGGCTGATCGCGGTCTTCGGCCCG

GCGCTGATCCCGTTCGTCATCATCCAGGCAGTCTTCGGCTTCAG

Clone Rv170
:::::::::::::Rv170SP6.seq:::::::::::::
ATACTCATGCTTGCCGAAGTTCCGATGGGTCGCGCCGGCGANCCCAGCGAAGTCGCTAGCGTGGCCGTGTTCTTGGCT (SEQ ID NO. 141)

TCGGATCTATCCTCGTACATGACCGGCACCGTGTTGGACGTGACTGGCGGCCGGTTCATATGACACCGAGATCATTGC

CACGGTACGGCAATTCGTCAAGAAGGAAATCTTTCCCAATGCACCGGCCCTCGAACGTGGCAACAGCTACCCGCAAGA

AATCGTCGATCGGCTGGGTGTTATTGGCTTGCTCGGTCGCCGGCTGCAAGGGTATCGACACCACCGAGTTCATTCTCC

GGGCGTGCC

:::::::::::::Rv170T7.seq:::::::::::::
GGCGTCAACGGTGTCGGCACCGGCGTCCTGCAGTTGGTAGGCCTGCAGTTTGTGCATCAGGCCGATGCCGCGGCCCTC (SEQ ID NO. 142)

GTGGCCACGCATGTACAGCACCACGCCGCGCCCCTCACGGGCGACCATCGCCAGCGCGGCGTCCAGCTGAGGCCCGCA

ATCGCAGCGGCGTGACCCAAACACATCGCCGGTCAAGCACTCCGAATGCACCCGGACCAGCACGTCGTCACCGTCGGC

GTTGGGCCCGGCGATCTCGCCGCGGACCAGCGCGACATGTTCCACGTCCTCGTAGATGCTGGTGTAGCCGATGGCGCG

AATCTCCCATGACGAGTCGGAATCCGCGCCTCGGCG

Clone Rv171
:::::::::::::Rv171SP6.seq:::::::::::::
ATACTCAAGCTTCGGCCTCGCTGCAGGAGTGGGAGCCGCAGGGCTGGAAATCCGAAAAACGAGCCGGTGATCCCACTG (SEQ ID NO. 143)

TCGCCGATCGGGGCCGCACCTGGTTGGTGTTACCGATGAATCCGCACCCAAAATGTGGCTGCGGTGGCGTTTCTTGAC

TCCTTGGCGTCGACTCTTGTGGCAGCCACCGAGCGGTTGGTCCAGGATCTGGATGGGCAAAGTTGTGCGGCCCGGCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GTGACGGCCGATGAGCTGACCGAGGTCGACAGCGCCGTGTTGGCTGACTTGGAACCGACATGGATTCGCCCCGGTTGG

CGTCACCTCAAGCATTTCAATGGTTAT

::::::::::::Rv171T7.seq::::::::::::
ATGCGTCACCCCGATGCGCCCAGATCGGGGCTTCGCAAATAAAGCACGAACAGGCGGGCAAAACGTCTATCTCGGAGC (SEQ ID NO. 144)

CGGAAGGGCAATCAGCCGACCGTCGACGAACGACACCGGCGATAACCACTTAGGCGTTGAACGGCCGGCCCAAACATT

ACGCCTCCGTTGATAAGGCTTTCGGTCTCTTCCCCGGTCATCCCAAGCACCTTGCGGCAAATTTGAACGCTTTCCTGT

CCGGGCACCGGCCCCGGGCTTTGGGGTCCNTCCGA

Clone Rv172
::::::::::::Rv172SP6.seq::::::::::::
ATACTCAAGCTTCAATCGCGCCGCCACAATCCAAATATGCGTCTAGCGTCTCGATGAGCGTCGGTCCGGCATCGGCTA (SEQ ID NO. 145)

GGGGCCGCATCACGTCGGTATGCAGGGCCACGATCGCCCAAGGCGTCGCCCATCAAGGGCGCGTTCGGGCAAAAATTC

CCCTATCCAGCACGGGCCGCGGCGCTCCGCNCCAGCCGGCGACGGCGTTCATCCCGGAGATCGCCTCGCTAGCGCTGC

GGTGCGCCGCGGTCAGCATGGGCGCCGTGGGGCCGATGACCACCGGGGCGT

::::::::::::Rv172T7.seq::::::::::::
TTCGGCGGGTCTGTAGATTGCGGTCGGCCACCCCACAGGCACTCATGAACCGCAGCCCACGATCGATCTCGGTGG (SEQ ID NO. 146)

Clone Rv173
::::::::::::Rv173SP6.seq::::::::::::
GCGCACCATCGCCAGTAGGTGCCCGTGGTCGGGCGCGTCGAGCCACCCGAGCGGAAACGCGAGTCCGAACAGCAACAG (SEQ ID NO. 147)

CAGGACGGGCGCAACCAGGGCGGTGACCATGCCCCCGGCGCTGAACATCAACCACAGGAAGGGCTCCGCCGAGCGTCC

GCGCGACC

::::::::::::Rv173T7.seq::::::::::::
CATCGTCGAACTTCGGTCCGGGTTGNTAGNACCGCAGCACCAAACGCACCCACCGACCCCCACGCTTCACCCCAACCC (SEQ ID NO. 148)

TTTAGTTCATTGGCGTGAACAGCAGCGTAGCCGGTTGCCCCGATATATGTGGAAAAATCGTTCGGACGTACAAAAAAA

GTTCCTGACGCTGGCGTCAACTCGAAACTGCCTCGGAAGTCAATGATGATCCATCAGTCAATATTAAAGTCG

Clone Rv174
::::::::::::Rv174SP6.seq::::::::::::
ATACTCAAGCTTGTCTGCTGCCTCAGCGTATGCATCCAACAGCGCATCGCGATCAACGATCAGGCGCGCCGATTTCGG (SEQ ID NO. 149)

GCCGCGGGCAGTGGCACTGGCCAGATGGCCGTTTTTTTCGAGAAACTTCAACGCCTGAGCGCTGCTTCCCATCGAGAG

ACCGGTGGCCTCTACAACCGATGCGACAGTTGGACCGGCGATGTTCGCCAGCAGCGCTTCACATACGGCAAGTNTGGC

GCGG

::::::::::::Rv174T7.seq::::::::::::
TTGTCCAGGCGGGGAATCGGGCAGGGAGACGACACCTTCGTTCGGTTCGATCGTCGCGAACGGGTAGTTGGCCGCGAC (SEQ ID NO. 150)

CACGTTGTTTCGGGTCAGCGCGTTGAAAAGTGTCGACTTGCCGACGTTGGGCAGGCCCACGATCCCCAGGCTCAAGCT

CACAGA

Clone Rv175
::::::::::::Rv175SP6.seq::::::::::::
ATACTCATGCTTGGCGCCTGGGTGGCAGCCCACCTGCCCACCACACGGACCGCGGTGCGGACGCGGCTGACGCGCCTG (SEQ ID NO. 151)

GTGGTCAGCATCGTGGCCGGTCTGCTGTTGTATGCCAACTTCCCGCCGCGCAACTGCTGGTGGGCGGCGGTGGTTGCG

CTCGCATTGCTGGCCTGGGTGCTGACCCNCCGCNCNACAACACCGGTGGGTGGGCTGGGCTACGGCCTGCTATTCGGC

CTGGTGTTCTACGTCTCGTTGTTGCCGTGGATCGGCGAGCTGGTGGGCCCCGGGCCCTGGTTGGCACTGGCGACGACG

TNCGCGCTGTTCCCCGGCATCTTCGGTCTGTTCGCCGTCGTGGTACCCTGTTGCCGGGTTGGCCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv175T7.seq::::::::::::
CGCCAATTCACGATATCGTTAACCGATATCCCGAGCCGATAGCTGGCGGGCTCGGGTGGTGGCCAGCGGCGCTGCGAC (SEQ ID NO. 152)

GAAAGGTGTGACCGTCATGAAACAGACACCACCGGCGGCCGTCGGCCGTCGTCACCTGCTCGAGATCTCAGCATCCGC

AGCCGGTGTGATCGCGCTTTCGGCGTGTAGTGGGTCGCCGCCCGACCCCGGCAAAGGCCGGCCCGACACAACCCCGGA

ACAGGAAGTCCCGGTCACCGCGCCCGAAGNACTTGATGCGCGAACNCGGAGTGCTCCAAACGCATCCTGCTGAT

Clone Rv176
::::::::::::Rv176SP6.seq::::::::::::
ATACTCAAGCTTGGGCACTGACTTCGGTACCCCCTCCGCCTTTGGCCAGCAGCAGCCACAGCGCGGTTCGCGGACCGA (SEQ ID NO. 153)

ACGTGGACATCAATAGCCCGGAATCGGTGTGTGCAAGTTGGTAAACGGTGTTGATCCCAAGCTTTGCCAGCCTTTTCG

TAGTCTTGGGCCCCACACCCCACAGTGCTTCGACGGTACGGTCACCCATGATGGCCATCCAGTTGGCATCGGTGAGCT

GATAAATGCCAGCTGGTTTCGCGAACCCGGTAGCGATCTTGGCGCGCTGCTTGTTGTCACTGATACCTATCGAGCAAG

ACAGCCCGGTTTGCGACAAAATGACTTTTCGGATCTCTTCGGCGACTTCGATGGGGTCGTCGGGA

::::::::::::Rv176T7.seq::::::::::::
AAAGTCCTGTGCCGGTTCGCTAAACACCCGGCGGACACTCAGACGGTGCTGGTGGTGCGGCATGGCACCGCGGGCAGC (SEQ ID NO. 154)

AAAGCGCACTTCTCCGGGGGACGACAGCAAGCGACCGCTAGACAAGAGGGGTCGTGCGCAGGCAGAAACGTTGGTACA

CAGCTGCTGGCGTTCGGCGCCACCGATGTTTATGCCGCCGACCGGGTGCGCTGCCACCAGACGATGGAGCCACTCGCC

GCGGAACTGAACGTGACCATACACA

Clone Rv177
::::::::::::Rv177SP6.seq::::::::::::
ATACTCAAGCTTGGGTTCCACGCCCGCGCAGCCACGCCGTCACCTTTCCACGAGACCTCACCTGCCGATCCGAAATGG (SEQ ID NO. 155)

AATCGGCCGTGACGGAATTGGCGCACCGAACACCCAACGAGGTGGTGGCTTCGTCGCGAACCGTCACCCGAGTCGCGG

CCACCGTGCGCACGGCGACGTTCTACACCCGCACCAAGATCCGAAAGCTGCAAGCTCCCAGCACCGATCCCGACGTCA

TCACCGCTGCCGCCCGGCACGTCCTTGACCTATTCGAGCTGGATCGGCCCGTCCGGTTGCTGGGAGTGCGGTTAGAAC

TGGCCTAGAACCGGCGGGCACACCGCNCCTGGGCGGGGCGAATTCTTGACCGCNCCGGCC

::::::::::::Rv177T7.seq::::::::::::
CGCGGTTGGCGTAGTTGGACGGGTCGCCCTCCGAGGCCAATGATGACGATGACCACGCCGATCACGATGGCCACCGAG (SEQ ID NO. 156)

AGGGACAACAACAGAAAGCTGACGAATCCCTCCTTGGCGGCCGGGGCTTTGTGGTCGCCGGTCGCGATGGGCGCGAAT

TTACGGCCCGCTCCCCCAGGCCGCCGCGAAGCAGGGTCCCCAGCCAGTTGGCGTAGGCGGAATTAACGATCAGCGCCA

CCGCGATAACCTGCCATGCCTCGGGCATATCGATGTGCGGCCAGAACAGGCCGAAC

Clone Rv178
::::::::::::Rv178SP6.seq::::::::::::
CCAACAAGAGCATCGGGACATACGGAGTCAACTACCCGGCCAACGGTGATTTCTTGGCCGCCGCTGACGGCGCGAACG (SEQ ID NO. 157)

ACGCCAGCGACCACATTCAGCAGATGGCCAGCGCGTGCCGGGCCACGAGGTTGGTGCTCGGCGGCTACTCCCAGGGTG

CGGCCGTGATCGACATCGTCACCGCCGCACCACTGCCCGGCCTCGGGTTCACGCAGCCGTTGCCGCCCGCAGCGGACG

ATCACATCGCCGCGATCGCCCTGTTCGGGAATCCCTCGGGCCGCGCTGGCGGGCTGATGACCGCCCTGACCCCTCAAT

TCGGGTCCAAGACCATCANCCTCTGCAACAACGGCGACCCGATTTGTTCNGACGGCAACCGGTGGCGAGCGCACCTAG

GCTACGTGCCCGGGATGACCAACCAGGCGGCGCGTTTCGTCGCGAGCAGGATCTAACCGCGAGCCGCCCATAGATTCC

CG

::::::::::::Rv178T7.seq::::::::::::
TAANACCCGTGTAATTTGGGATGGGCAAAAAGGCCAAGCACCGCGTGGCCACGAACGCCGGGAGGGACAATCTCGGGC (SEQ ID NO. 158)

GGCTAGGGCTTCTCGCGGGAAGGCCCGAACGTACGGCGTTTCAACACGTCGCGTCNCCCTCCGACCGCGAACATTCGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGATGGCAGCAACCTGGTAGCNCCCTGGCCGGGCGATGATCTGCAGCGTCGCCGCGGGTAGTCGCCGCCCGGGCGGCT

ACAGTCTGAAACGCGATGACCATCGATGTGTGGATGCAGCATCCGACGCAACGGTTCCTACACGGCGATATGTTCGCC

TCGCTGCGCCGGTGGACCGGTGGGTCTATCCCGGAGACCGACNTCCCGATCGAAGCGACCGTCTCCTCGATGGACGCC

GGCGGCGTCACCCTGGGTTTGCTCACCGCCTGGCGTGGCCCCAA

Clone Rv179
::::::::::::Rv179SP6.seq::::::::::::
GTCCGCAAAAGACTCAGCGGCCGACTTTGCTCGCAGCTGGCGGTACCGCGCCACCGATTCGATGCCGTGGTCGCGGAA (SEQ ID NO. 159)

GAATGCCTCCCGAAATCGCACGGCCGACTCCAGTTCGGCGAGCATCCGCGATGCCAGCTGCGGCTGCGCCCTGCCGGC

CACGGCACCCACATGCGGCAGTTCGTCCACCTGGGCCAGCGCCCCGCCGCCGAAGTCCAAACAATAGAACTGCACCCG

GCCCGCATCGTGGGTAGCAGCCAACGCCATGATCAGCGTCCGCAGCGCGGTTGACTTGCCCGTTTGCGGTGCACCTAC

GACCGCGACATTGCCTGCGGCCCCGGACAAGTCGATCGTCAGCGGCACCCN

::::::::::::Rv179T7.seq::::::::::::
CGTGGCCACGAACGCCGGGAGGGACANTCTCGGGCGGCTAGGGCTTCTCGCGGGAAGGCCCGAACGTACGGCGTTTCA (SEQ ID NO. 160)

ACACGTCGCGTCGCCCTCCGACCGCGAACATTCGGGGATGGCAGCAACCTGGCAGCTACCTGGCCGGGCGATGATCTG

CAGCGTCGCCGCGGGTAGTCGCCGCCCGGGCGGCTACAGTCTGAAACGCGATGACCATCGATGTGTGGATGCATCATC

CGACGCAACGGTTCCTACACGGCGATATGTTCNCCTCGCTGCGCCGGTGGACCGGTGGGTCTATCCC

Clone Rv17
::::::::::::Rv17SP6.seq::::::::::::
ATACTCAAGCTTTGCGGCGGGCGCCGAAATGTGAACGCACCAAACCCGCCCGCTGCGGGTCGGCGGGCCACTCGACCT (SEQ ID NO. 161)

CGAATTTCGCCGCCGTGACCATCCAGCCCGACGGCAGTTGGGCACCCGGCCCCCCGGTCGCGGCATAACTGTTGGCGT

CGCCGTCATAAAGCTCGAACAGCACCGAAACCGACTCCACCACCGGCCGGTGCGCCTCAAAATCCACGCCGATCTCCA

CATACCGGGAAAACGTCGGTGTCCCATCGGGTTTCGGCTTGCCCGCCAGCTGCACACCACCGGTGGCCTCGGCCACCT

TCGCGGCCTGAGCGCAGCTACNCATCCTGACGATCATCACCCCGCCCCCGGCTCACGCTTGGCCTCCGTCACCGCACG

CATCGCCCGGTTGCGCGCACCGCGACGCCCGTACAGCCGCGCGCAC

::::::::::::Rv17T7.seq::::::::::::
AGCTTGCCGGGACTGCGGAACAGAAGCGGCGGTTCCTACCGCGGTGTGCGGCCGGCGCGATATCGGCCTTTTTACTAA (SEQ ID NO. 162)

CCGAACCCGATGTGGGCTCCGATCCGGCGCGCATGGCATCGACGGCGACGCCGATCGATGACGGCCAGGCTTACGAGC

TTGAGGGTGTGAAGTTGTGGACCACCAACGGTGTGGTAGCGGACCTGCTAGTGGTTATGGCGCGGGTACCGCGCAGTG

AAGGGCACCGAGGGGGAATCAGCGCCTTTGTCGTCGAGGCTGATTCGCCCGGGATCACCGTGGAGCGGCGCAACAAGT

TCATGGGACTGCGTGGCATCNAAAACGGCGTGACCCGGCTTCATCGCGTCNGGGTGCCCAAAGACAACTTGATCGGCA

Clone Rv180
::::::::::::Rv180SP6.seq::::::::::::
CTCAAGCTTGGCGATGCGGGCTGGCCAAAACTGGCCGGGCGGGGGTTGGCTTGTTCAATCAAGGGTGGGTTGCCG (SEQ ID NO. 163)

::::::::::::Rv180T7.seq::::::::::::
CCGAAGGCCCGTTCCCGGGCGTTCAGCAAGCGATCGTCGGTTGGCCCACTGCGGGTCGAATCTTGCGGCCGCGCCGGT (SEQ ID NO. 164)

CGTGGAACGCCCAGGTCACCCGGCGGCGTACC

Clone Rv181
::::::::::::Rv181SP6.seq::::::::::::
ATACTCAAGCTTTTTCTGCTCATGAAGGTTAGATGCCTGCTGCTTAAGTAATTCCTCTTTATCTGTAAAGGCTTTTT (SEQ ID NO. 165)

GAAGTGCATCACCTGACCGGGCAAATAGTTCACCGGGGTGAGAAAAAAGAGCAACAACTGATTTAGGCAATTTGGCGG

TGTTGATACAGCGGGTAATAATCTTACGTGAAATATTTTCCGCATCAGCCAGCGCAGAAATATTTCCAGCAAATTCAT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TCTGCAATCGGCTTGCATAACGCTGACCACGTTCATAAGCACTTGTTGGGCGATAATCGTTACCCAATCTGGATAATG

CAGCCATCTGCTCATCATCCAGCTCGCCAACCAGAACACGATAATCACTTTCGGTAAGTGCAGCAGCTTTACGACGGC

GACTCCCATCGGCAATTTCTATGACACCAGATACTCTTCGACCGAACGCCGGTGTCTGTTGACCA

Clone Rv182
::::::::::::Rv182SP6.seq::::::::::::
CTCAAGCTTGGTGCCGACATGGCCGGGCTGGAGCCCGCGTATGGCAAGGTTCCGCTCAATGTGGTTGTGATGCAGCAG (SEQ ID NO. 166)

GACTACGTTCGCCTCAATCAGCTCAAACGTCACCCCCGTGGCGTGCTGCGCAGCATGAAGGTCGGCGCCCGCACGATG

TGGGCGAAGGCAACAGGTAAAAACCTGGTCGGCATGGGTCGAGCCCTCATTGGGCCGTTGCGGATCGGGTTGCACCGC

GCCGGAGTGCCGGTCGAACTCAACACCGCCTTCACCGATCTTTTCGTCAAAAATGGCGTCGTGTCCGGGGTATAC

::::::::::::Rv182T7.seq::::::::::::
CCGAAGCGTGGGAAATCCTGACCGAATACCGCGACGTGCTGGACACTTTGGCCGGCGAGCTGCTGGAAAAGGAGACCC (SEQ ID NO. 167)

TGCACCGACCCGAGCTGGAAAGCATCTTCGCTGACGTCTAAAAGCGGCCGCGGCTCACCATGTTCGACGACTTCGGTG

GCCGGATCCCGTCGGACAAACCGCCCATCAAGACACCCGGGGGAGATCGCGATCGAAACGCGGCGAAACTTGGGCC

::::::::::::Rv183SP6.seq::::::::::::
CGACTCGACAAGCATTCTTGACAGTTGTTTTGGCTCGGCATGGTTAGCCAAGGTTCTGCGGTCCCACCAGATCATCTT (SEQ ID NO. 168)

GGTCCGGTAGCGCTCGTCCGGGTATGCTGCCGCCGGGATTCTCGCTGCTATTACTCCCCCCGAAAAACGCCACCGGTC

CAGCGCGTGGGCCGCCGCGGTCCCCATCACAAACTGAACCCCCAACAGGGGACATGCTTAGCGGTAGGGCGCGCGCCA

AGGCGGCAGCAATCGCATCACTGCGCTGCGCGTCACTATTAACCCACCCGGACTTCACTTCCACGACCCCGAATGGCG

CCCGGTCATTGATCATCTTGCGCACCGCGGATAATCCGGGATTGCCAGCCCATTCGACTACCGCATGCGAGTCATCGG

CTGACCGCAGCGGTCCGATTACCCGAGCGCCCCGANTACATCTCCTCCAATATCAATGGGCGCAA

Clone Rv183
::::::::::::Rv183T7.seq::::::::::::
GCGGTNTAGCTTCCCGTCGTACCGGCGACCGCCAGCCGAGAAGCTCGTTTTCCCAGTGTTGCTGGGGATTCTCACGCT (SEQ ID NO. 169)

GCTGCTGAGTGCGTGCCAGACCGCTTCCGCTTCGGGTTACAACGAGCCGCGGGGCTACGATCGTGCGACGCTGAAGTT

GGTGTTCTCCATGGACTTGGGGATGTGCCTGAACCGGTTCACCTACGACTCCAAGCTGGCGCCGTCTCGTCCGCAGGT

CGTTGCTTGCGATAGCCGGGAGGCCCGGATCCGCAATGACGGATTCCATGCCAACGCTCCGAGTTGCATGCGGATCGA

CTACGAATTGATCACCCAGAACCATCGGGCGTATTACTGCCTGAAGTACCTGGTGCGGGTCGGATACTGCTATCCGGC

GGTGACGACCCCCGGCAAGCCGCCATCCGTGCTGCTGT

Clone Rv184
::::::::::::Rv184SP6.seq::::::::::::
CTCAAGCTTGGGCGTGACGGCCACCGGGGCCACTCCGCACAATCTGTACCCGACCAAGATCTACACCATCGAATACGA (SEQ ID NO. 170)

CGGCGTCGCCGACTTTCCGCGGTACCCGCTCAACTTTGTGTCGACCCTCAACGCCATTGCCGGCACCTACTACGTGCA

CTCCAACTACTTCATCCTGACGCCGGAACAAATTGACGCAGCGGTTCCGCTGACCAATACGGTCGGTCCCACGATGAC

CCAGTACTACATCATTCGCACGGAGAACCTGCCGCTGCTAAAGCCACTGCGATCGGTGCCGATCGTGGGGAACCCACT

GGCGAACCTGGTTCAACCAAACTTGAAGGTGATTGTTAACCTGGGCTACGGCGACCCGGCCTATGGTTATTCC

::::::::::::Rv184T7.seq::::::::::::
CGGGTGTCATTGGCCACCGGCGGCGGCTGTCCGGGAAATGGCGGGTCCCCGGTGGTTTTGCTGAGGAGTGCTGAACCG (SEQ ID NO. 171)

TAGTCGAAGTGGGCGGCGTCAGACTCCACCCAGCCAGCAGGCAGCGCGAAGCTGAATCCTCCAACCGGGTTGTCGATC

CGGACAGGTTGGGGTGCGTTTGGGGCAATGACAGGTGGCGGCGGTGCGTTCGGGTCGGCCGGCGGAGGTGCTGCGTTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGATCGCCCGGCTGGGCATTCGGCGTGTTGGCGGCGGCCGGTGGTGGGGGGGCAACANGTGTCGCCGGTGCGGGTGGC

GCTGCA

Clone Rv185
::::::::::::Rv185SP6.seq::::::::::::
NCTTGATATTGGCGTCAACGGTGTCGGCACCGGCGTCCTGCAGTTGGTAGGCCTGCAGTTTGTGCATCAGGCCGATGC (SEQ ID NO. 172)

CGCGGCCCTCGTGGCCACGCATGTACAGCACCACGCCGCGCCCCTCACGGGCGACCATCGCCAGCGCGGCGTCCAGCT

GAGGCCCGCAATCGCAGCGGCGTGACCCAAACACATCGCCGGTCAAGCACTCCGAATGCACCCGGACCAGCACGTCGT

CACCGTCGGCGTTGGGCCCGGCGATCTCGCCGCGGACCAGCGCGACATGTTCCACGTCCTCGTAGATGCTGGTGTAGC

CGATGGCGCGAAACTCCCCATGACGAGTCGGAATCCGCGCCTCGGCGACCCGCTCAATGTGCTTCTCGTGCTTGCGCC

GCCATTCGATCAAGTCAGCAATGGTGATCAGCGCCAGACCGTGCTCNTCGGCG

::::::::::::Rv185T7.seq::::::::::::
CATAAGGGCCGGCGTACCCGGTACCGGCCGCGGGCCTACCACGTGCCGGAACTGGAAGCGCAGTAAGCCCTCAACGCG (SEQ ID NO. 173)

CCACCGCTTTGGCCCGCGCGCCCGGCGTAGGCGCATCGGCGGTGGCCGTGGGGCGGCGCACTGCGACCTCACCAGCGG

CTTTCGAGCTTTGTTCGATCAACCGGCCAGCATGGTCGAGGATGCATTCGAGACCATATTCGAAATTGGTTTCATCGG

GGGCCCCGATCCGATGCCCCCTCCCAGTTGCGTGAGCAAGCAGCGGAGTCGTCGCGGGATCCATGGCCACGGGGTGTT

CAATGGCGGATGGTCCGCTGCCCGCCGACTGGCTCTTGCGGGAGAGCCGATCTAGCACCACCGATCCGCGCACGTGGA

CCGAAACCGCCGAGTAGATGTCGAAAGCGT

Clone Rv186
::::::::::::Rv186SP6.seq::::::::::::
CGTCCTTTTCCCCAAGATAGAAAGGCAGGAGAGTGTCTTCTGCATGAATATGAAGATCTGGTACCCATCCGTGATACA (SEQ ID NO. 174)

TTGAGGCTGTTCCCTGGGGGTCGTTACCTTCCACNAGCAAAACACGTAGCCCCTTCAGAGCCNNATCCTGAGCAANAT

GAACAGAAACTGAGGTTTTGTAAACGCCACCTTTATGGGCAGCAACCCCGATCACCGGTGGAAATACGTCTTCAGCAC

GTCGCAATCGCGTACCAAACACATCACGCATATGATTAATTTGTTCAATTGTATAACCAACACGTTGCTCAACCCGTC

CTCGAATTTCCATATCCGGGTGCG

Clone Rv187
::::::::::::Rv187SP6.seq::::::::::::
CTCAAGCTTCATGTCCGTACGGCTCGGGTACGCTTCCGTCGCAGTGTGCGAGTGATAAATGACGACCGGGACCTCGTC (SEQ ID NO. 175)

GGCATCTTCCATAGCCCGCCACACCTTCAGTTGCTCACCGGAATCCAACCGGTAGAAGGTCGGCGAGCGCTCGGCATT

GGTCATCGGGATATGCCGCTCGGGACGGTCAGAGCCCTCGGGTCCGGCCAGCACTCCGCAGGCTTCGTCGGGGTGGTC

GCGACACGCATGGGCCACCATCGCATTCAC

::::::::::::Rv187T7.seq::::::::::::
NCGCCGCCAGCCACCACGCGCGGGTCGGGCGCCGGGCCCGGGCCGCCAGGCTGCTCCGCTCGGTGATGGCACGCCACC (SEQ ID NO. 176)

GCGACACCACCCGGCTGCGCTACGTCGAGCCATACCGGGCGGAGCTACATCGGCTCGGCCGCCCAGTGTTCGGGCCCT

CTTTCGAGGTCGAGGTCGATACCGATTTGCGCATCCGCAGCCGCACCCTGGACGACAGAACCGTGCCCTACGANTGCT

TGTCGGGCGGGGCCAAAGAACAGCTTGGCATCCTGGCGCGATTGGCCGGCGCGGCGCTGGTCTCCAAAGAAGACGCCC

TTCCGGTGCTGAT

Clone Rv188
::::::::::::Rv188SP6.seq::::::::::::
CGCCACGTTCATGGGCAACAACCCCGATCACCGGTGGAAATACGTCTTCAGCACGTCGCAATCGCGTACCAAACACAT (SEQ ID NO. 177)

CACGCATATGATTAATTCGTCCAATTGTATAACCAACACGTTGCTCAACCCGTCCTCGAATTTCCATATCCGGGTGCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GTAGTCGCCCTGCTTTCTCGGCATCTCTGATAGCCTGAGAAGAAACCCCAACTAAATCCGCTGCTTCNCCTATTCTCC

AGCGCCGGG

Clone Rv189
::::::::::::Rv18SP6.seq::::::::::::
ATACTCAAGCTTCAACCGATTGACGCATTGTGCGAACTGACGGCGCCCGCGCATGGCCAATCCGGAAGACCATCATTG (SEQ ID NO. 178)

GCCAGTGGCCGGGCGCTAACAGGTTCCAGCCCCCCACCAGTGCCGCTCGAACATGCGGTGCAACCCATTCGCAGGCCG

GCAGGGAAAGCACCGCGGAAGCCGCAAAGGGCTGCAGTTCCGCGCCCAATAGTGTCGTCCGCAACCAGATGCGCTCGA

AAACCGCGCCGGCAGTCAGCGCACCCGACGCGAGGTCGAGAGACGTCGTCAGCGCGCCCACATGGGGTGCCAATCGGC

ACGGCAGGTAGGCCGCGCGCAACCCGAACGCGTGGTGCATGCCCACGGTCCGCAGGAGGCGCAGCACCCGCCAATGCC

GAAGCCCACGAAACATCGGGCGCATCCACGCTTCAACCTC

Clone Rv18
::::::::::::Rv18T7.seq::::::::::::
AGCTTTTGGCAGGGTCTCCTTCGAATTCGGCGTGCACCGCTATGGGTTGCAGCAGCGGCTGGCGCCGCACACCCCACT (SEQ ID NO. 179)

GGCCCGGGTGTTTTCGCCCCGAACCCGGATCATGGTGAGCGAAAAGGAGATTCGCCTGTTCGATGCTGGGATTCGCCA

CCGCGAGGCCATCGACCGATTACTCGCCACCGGGGTGCGAGAGGTGCCGCAGTCCCGCTCCGTCGACGTCTCCGACGA

TCCATCCGGCTTCCGCCGTCGGGTGGCGGTAGCCGTCGATGAAATCGCTGCCGGCCGCTACCACAAGGTGATTCTGTC

CCGTTGTGTCGAAGTGCCTTTCGCGATCGACTTTCCGTTGACCTACCGGCTGGGGCGTCGGCACAACACCCCGGTGAG

GTCGTTTTTGTTGCAGTTGGGCGGAATCCGTGCTCTGGGTTACAGCCCGAATCGTCAC

Clone Rv190
::::::::::::Rv190SP6.seq::::::::::::
ATACTCAAGCTTTGTCACACCAACTGTTTCCACCAGGCGCTCCATCCGGCGAGTGGATACTCCCAGCAGGTAGCAGGT (SEQ ID NO. 180)

CGCCACCACGCTGGTCAGTGCGCGTTCAGCTCGCTTGCGGCGCTGCAGCAGCCAGTCCGGGAAATAGCTGCCCTGGCG

CAGCTTGGGGATCGCGACTTCTATGGTTGCGGCACGGGTGTCGAAATCACGGTGGCGGTAGCCGTTGCGCTGATTGGA

CCGCTCATCGCTGCGTTCGCGGTAGCCCGCCCCGCACAGGGCGTCGGCTTCAGCCCCCATCAAGGCGGCGATGAACGT

CGAGAGCAGCCCGCGCAGCAGATCCGGGCTCGCCTGTGCGAGTTGGTCAGCCAGAACCTGCTCGGTGT

::::::::::::Rv190T7.seq::::::::::::
CCTTAAGCCCCGCAGGGCCCGGCACGCGCGGTACCGCCCAGGTCGCCCAACAGATCGTCGATGTTCGCGTCGTCCGCC (SEQ ID NO. 181)

TCGCGCACGTGGTCTGTCACCAGTCAACGTTAACGCCGCCGCACATGTCCTGCGGCCGGGCAAAAACGTGAAAAACGA

GCGGGCGACTGCAATGTCATGACACCGACGGCCGCCGATGGGCCCAGGGTCTGGCAGATTCGATCTGTGCGGCCAGTG

CCAGCAGCGTCGCCTCGTCATACGGCCGGCCGACGAGTTGAACCGACATGGGCAGGCCGTCGCCGTCGAAGTCCCACG

GCACCACGGCCGCGGGCTGGCCGGTCAGATTCCAGACTTGAAAGTACGGAACCCGCTGCACCACCAGCAGCAACGTCG

AAACTGCACCCCGGCGTTGGTAGGCGCCGATGCGGGACGGGCCGGTCGCGGCGCCTGGCGTCACAACTACGTCGACAT

CGTCGAAGATCGACTGGATCGGCTGCTCACACCACTCGGCGGCCGCAGGCCGCCATCCGCCCTC

Clone Rv191
::::::::::::Rv191SP6.seq::::::::::::
AGCTTTTTGAGCGTCGCGCGGGGCAGCTTCGCCGGCAATTCTACTAGCGAGAAGTCTGGCCCGATACGGATCTGACCG (SEQ ID NO. 182)

AAGTCGCTGCGGTGCAGCCCACCCTCATTGGCGATGGCGCCGACGATGGCGCCTGGACCGATCTTGTGCCGCTTGCCG

ACGGCGACGCGGTGGGTGGTCAAGTCCGGTCTACGCTTGGGCCTTTGCGGACGGTCCCGACGCTGGTCGCGGTTGCGC

CGCGAAAGCGGCGGGTCGGGTGCCATCAGGAATGCCTCACCGCCGCGGCACTGCACGGCCAGTGCCGCGGCGATGTCA

GCCATCGGGACATCATGCTCGCGTTCATACTCCTCGACCAGTCGGCGGAACAGCTCGATTCCCGGACCGCCCAGCGCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TTGGTGATGGAATCGGCGAACTTGGCCACCCGCTGGGTGTTGACATCCTCGACGGTGGGCAATTGCCCCCGGTAACGT

TTGCCGCCT

::::::::::::Rv191T7.seq::::::::::::
CGGTCCGACCCTGTTCGACGGCTACCTGAATCAACCCGATGCCACCGCCGCGGCGTTCGACGCCGACAGCTGGTACCG (SEQ ID NO. 183)

CACCGGCGACGTCGCGGTGGTCGACGGCAGTGGGATGCACCGCATCGTGGGACGCGAGTCGGTCGACTTGATCAAGTC

GGGTGGATACCGGGTCGGCGCCGGTGAAATTGAAACGGTGCTGCTCGGGCATCCGGACGTGGCGGAGGCGGCAGTCGT

CGGGGTGCCCGACGATGATCTAGGCCAGCGGATCGTTGCCTACGTAGTCGGCTCAGCGAATGTCGATGCGGACGGGCT

TATCAACTTTGTTGCCCAACAACTTTCGGTGCACAAGCGCCCGCGCGAGGTGCGTATCGTANATGCGCTGCCGCGCAA

CGCCTTGGGGAAAGTGCTCCAGAACATTGCTGTCAGAAGCTGANCTACGCGAATTATCGTGTTACGCTGGA

Clone Rv192
::::::::::::Rv192SP6.seq::::::::::::
ATACTCAAGCTTGCCGAAGTTCCGATGGGTCGCCCCGGCGAGCCCAGCGAAGTCGCTACCGTGGCCGTGTTCTTGGCT (SEQ ID NO. 184)

TCGGATCTATCCTCGTTCATGACCGGCACCGTGTTGGACGTGACTGGCGGCCGGTCCATATGACACCGAGATCATTGC

CACGGTACGGCAATTCGTCAAGAAGGAAATCTTTCCCAATGCACCGGCCCTCGAACGTGGCAACAGCTACCCGCAAGA

AATCGTCGATCGGCTGGGTGTTATTGGCTTGCTCGGTCGCCGGCTGCAAGGGTATCGACACCACCGAGTTCATTCTCG

GGCGTGCCGGCGCATTCGAGCTGGCGGTGCGCGCTGCCCAGCACCGTCATAGGTACTTGACGATGGTCCACGTCGGAC

GAGCGCCTCCACGTCGCTGCCGAACGGTATGCATGGCGGCTACGATTCTC

::::::::::::Rv192T7.seq::::::::::::
CGGTGTCGGCACCGGCGTCCTGCAGTTGGTAGGCCTGCAGTTTGTGCATCAGGCCGATGCCGCGGCCCTCGTGGCCAC (SEQ ID NO. 185)

GCATGTACAGCACCACGCCGCGCCCCTCACGGGCGACCATCGCCAGCGCGGCGTCCAGCTGAGGCCCGCAATCGCAGC

GGCGTGACCCAAACACATCGCCGGTCAAGCACTCCGAATGCACCCGGACCAGCACGTCGTCACCGTCGGCGTTGGGCC

CGGCGATCTCGCCGCGGACCAGCGCGACATGTTCCACGTCCTCGTAGATGCTGGTGTAGCCGATGGCGCGAAACTCCC

CATGACGAGTCGGAATCCGCGCCTCGGCGACCCGCTCAATGTGCTTCTCGTGCTTGCGCCGCCATTCGATCAAGTCAG

CAATGGTGATCAGCGCCAGACCGTGCTCATCGGCGAACACCGCAATTCATCGGTGTTGCGCCATCGAGCCCTCATCTT

TTTGGCTGACGATCTCGCAAATCGCCCCCGCGGGTTGCAGCCGGCAT

Clone Rv193
::::::::::::Rv193SP6.seq::::::::::::
ATACTCAAGCTTTGGGTGAAAGCCGATCACCGGAAGCCGCATGATCAGCCACGTTTCCCGCCGCCCGGCATACGGCGG (SEQ ID NO. 186)

CGTACCGATCTCCGCGTCATACACCCGCGGGTAATCGCCGACGGTGCCGGTTCGCGAGCCGAAGGTGACGACGCTGAT

TGAATCGAGTTCCAGGTCCAGCGGGTGGCGCAGCAACGGCGCGAGCTCAACGACGTCAATCACGTTGTCGCTTTCTAC

GGTCACCGACCCGGTGACCGTNCTCGCCCGGTGCGCTCGGCCGATAAGTTGCACCGCCACCACCGCGACACCGTCTTG

CACGCGGACCCACCCCCGGATCCGTTGTTGGCC

::::::::::::Rv193T7.seq::::::::::::
AGCTTGCTGGCATCCGCTCCAGTAGCGCCCCGCGCGTGGCTTCCAGCGCCCGCAGATGCTCCATGAGCCGGCCGGTCG (SEQ ID NO. 187)

AGTCGGCGCCGGCGTTCACCGCCACCCGCCAGGAGCTGGCGGCCAGCATCTCCGCCTTCACGCATTGCGCGATCACAG

AGAGAATATACGTCTCATATTCGTTGGAGGTCGTCGCAGGCAATCGGTCGATGACGGATTTGATGGCATCGAGCTGTG

CTTCGGCGTAGCCCTCCAGCACGTCGGTATCGCTGTGGCGGTCCACGACGACCGCACCGGCGCGGCGGACAGCCGTCG

GGTTGGACGNTGTGCGGCGATCAGTCCGGCCAGCTCCGCCTCGGGATCAGCGGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv194
::::::::::::Rv194SP6.seq::::::::::::
ATACTCAAGCTTGCTGCAGCTTCCTATGACTGCTCCCGAAACCTGGGGGTGTGCCTGCTGTGTATGCACGGCATACGG (SEQ ID NO. 188)

ACATCCTTCCCCTGAGACCCGCGGTCGAACCAGCCACGTGTCCATCATCAGGGGTCAACCCCGGCCAAGGGCGACGGC

ACGCCAAGTTCGCCGACCGTTAACCTAGTGCTGTTAGCTTCATTTGCTGCGAGCAAAACAGCTGGTCGGCCGTTAGGA

ACTGAATTGAAACTCAACCGATTTGGTGCCGCCGTAGGTGTCCTGGCTGCGGGTGCGCTGGTGTTGTCCGCGTGTGGT

AACNACNACAATGTGACCGGGGGAGGTGCAACCACTGGCCAGGCGTCGGCGAAGGTCGATTGCGGGGGGAAGAAGAAC

TCAAAGCCAGTGGGTCGACGCGCAGGCCAACGC

::::::::::::Rv194T7.seq::::::::::::
AGCTTGACGCGGAGACGGACACATTGCGAACATTGATGACAAAATAGAAATCATTGATGGTTTGAGTCACCAGGCCGA (SEQ ID NO. 189)

TCAAGCCTTCGCCGAGCCAAATTCCAATCAAGAGGCCCAAGCCCGTACCAATCAGCCCGGCAACGAGGGATTCCGTCA

TTATCAGCCAAAATAACTGCTCTCGGGTTACACCCAAACAGCGCAATATGGCGAAAAACGGTCGCCGTTGCACGACAT

TAAATGTCACGGTATTGTAGATTAAAAAGATACCCACCAACAAGGCAATCAAACTGAGAGCGGTTAAATTGACCGTAA

AAGCGTCCGTCATCTGTTTGACGGTGTCCCGTTGGGTATCCGACGTTTCCATACGCACACCGGCCGGCAGTCTTTGTT

GGATGCGTGTTGCAGTGGCCTCATCTTTGATGATCAAATCGATGTGGCTCAGTCTTCCGGGCA

Clone Rv195
::::::::::::Rv195SP6.seq::::::::::::
ATACTCAAGCTTCGGCTCAGGCGGCGCTGCTGGTAAAGTCGCTGACCGGTGCAGGTTTCGACAATGTGGTGCCGGTTC (SEQ ID NO. 190)

GGCGGCTACGTGCCATCGAGACACTGGCGCAGGCTATCGCACCCGTTATCGGCTACGAGCAAATCGCGGTATGCGTTC

TTGAGCATGAGTCGGCGACCGTCGTCATGGTCGACACCCACGACGGAAAGACGCAGATCGCCGTCAAGCATGTGTGCC

GCGGATTATCAGGACTGACCTCCTGGCTGACCGGCATGTTTGGTCGCGATGCCTGGCGCCCGGCCGGCGTGGTCGTGG

TCCGCTCGGATAGCGAGGTCAGCGAATTCNCNTGGCAGCTCCAAAGGGTCCTGCCGGTGCCGGTCTTTGCGCAAACNA

AGGCNCAGGTTA

::::::::::::Rv195T7.seq::::::::::::
TGATCGCGCATCACCTGCTTCATAAACTGGAAGCAGCGCAGCGCTTCCTTTTCGGCCGCAACATCAGCCAGCCTCTCG (SEQ ID NO. 191)

TCGGCGGTCGGGTGCAGGTGCTCGGGCAGCTCGGCCGCGACAGCCGCCTGACCCTGAAACCAGCTTCCATATCCC6CG

ACGAACGACGCCAGTCCGCTACGTAACCCCTCCGCGACTGTCCATGGACAACAGCGCGTTCTCCACCGACCGGGCCCG

GGTGTGGGGTGTTTCGGCGACCGGCAGCCAGGTGGTCCACACTGCCGACGGGCGCCGCGAGCCGTTCACCGACCAGGC

CGCCGAGCAAGTCCGCCCGATCGCATACTCCAACCGGTTGCGGTACTGCAGGTTCAGCTGGCGTACTCCTCGTCGCGC

TCGGCGAGGTCTTGCTCCAGCACGTCGCANACGGCAG

Clone Rv196
::::::::::::Rv196SP6.seq::::::::::::
CAAAGCGCGAACTGCTCGCGGCAGCCCACGACGTGCTGCGTCGGATTGCCGGCGGCGAAATCAATTCCAGGCAGCTCC (SEQ ID NO. 192)

CGGACAATGCGGCTCTGCTGGCCCGCAACGAAGGACTCGAGGTCACCCCGGTGCCCGGGGTCGTGGTGCACCTGCCGA

TCGCACAGGTTGGCCCACAACCGGCCGCTTGATGCCCGGTCGGCAAGCCCGGCAGTTGCCAAACCCAGCGTGATCAGG

CTCGGCTCGCGAGTTCCGGGAAGAAGTGGCTCCGCCTGATCACCTACCATCCGCCAGGATCTGCGTGTCTTCACCACG

CCCGCCAAGGAGGTTGTTGTGGTGCTATCGACCGN

::::::::::::Rv196T7.seq::::::::::::
CCGGAAGCCGCATGATCAGCCAAGTTTCGCGCCGCCCGGCATACGGCGGCGTACCGATCTCCGCGTCATACACCCGCG (SEQ ID NO. 193)

GGTAATCGCCGACGGTGCCGGTTCGCGAGCCGAAGGTGACGACGCTGATTGAATCGAGTTCCAGGTCCAGCGGGTGGC

TABLE 3-continued

| End-sequences of the polynucleotide inserts cloned in the named recombinant BAC vectors contained in the I-1945 *M. tuberculosis* H37Rv genomic DNA library. RvXXXSP6 corresponds to the SP6 end-sequence of the clone RvXXX. RvXXXT7 corresponds to the T7 end-sequence of the clone RvXXX. RvXXXIS 1081 corresponds to a region located close to a copy of the IS1081 repetitive sequence (Insertion element). The character << - >> denotes an uncertain base residue. |
|---|

GCAGCAACGGCGCGAGCTCAACGACGTCAATCACGTTGTCGCTTTCTACGGTCACCGACCCGGTGACCGTNGTCGCCC

GGTGCGCTCGGCCGAAAANTTGCACCGCCACCACCGCGAAACCGTCTTGCACNCCGGAAGCCACCCCCGATCCGTTGT

TGGGCCAGGTTATTGGGT

Clone Rv19
:::::::::::::Rv19SP6.seq:::::::::::::
CCGGAACCGCCGACGGCACGGTATAACGCCTCCGCATATGGGTCGACAACCAGCGGGTCGGACTTCTGGGCTTCTAGC (SEQ ID NO. 194)

GTTCGCGCNGTCGCGACAAACAGCGCGGTCGAACCGACACTCGTTGTGATGTCCTAGCTATCACGTTCGGTACGCACC

CAATCGAGTCTAGCGCGGGTAGNTCAGCCCCGATCTCCANGCTCCGCCGAGCCAGGCGC

:::::::::::::Rv19T7.seq:::::::::::::
CTGGTTTATGTCCCGTTGAAGTTCCATCACCCGATGTGGCGGGAGCACTGCCAGGTCGATCTCAACTACCACATCCGG (SEQ ID NO. 195)

CCGTGGCGGTTGCGCGCCCCGGGGGGTCGGCGCGAACTCGACGAGGCGGTCGGAGAAATCGCCAGCACCCCGCTGAAC

CGCGACCACCCGCTGTGGGAGATGTACTTCGTTGAGGGGCTTGCCAACCACCGGATCGCGGTGGTTGCC

Clone Rv1
:::::::::::::Rv1SP6D2.seq:::::::::::::
CCGAGCAGTTGGGAATCGCTCTGCANCAAACCAATATTCTGCGCGACGTCGCGCGACGAGCTGGACCGATTAGCCGTA (SEQ ID NO. 196)

CGCCTCCGNCTGGACGACACCGGGGCACTCGATGACCCCGACGCCTACGCTCGCAGGATATTGTTCGCCGGACCCCTC

TCTAG

:::::::::::::Rv1T7.seq:::::::::::::
TATATAATACTCAAGCTTGCCGACGCCAACGCTCGCGCGATGTTCTTAGCCCGACCCGGCTCTTACATGGCACCGGTG (SEQ ID NO. 197)

CCCCACACGTCAGCCTGTGACGTCCTGCACCGCGACTCTTTACATAGAATGTGGATTGCCGGATTGGGGATGTCCGGC

ATCGCTCAATCTGTAGTCCGCGTTGTCCCGCGAGGGCCATGTGGATGGGGGGAAGGATCCGTGGCGTCCGGGATCACC

ATGGGG

Clone Rv201
:::::::::::::Rv201SP6.seq:::::::::::::
ATACTCAAGCTTGCCGAAGTTCCGATGGGTCGCGCCGGCGAGCCCAACGAAATCGCTAGCGTGGCCGTGTTCTTGGCT (SEQ ID NO. 198)

TCGGATCTATCCTCGTACATGACCGGCACCGTGTTCGACGTGACTGGCGGCCGGTTCATATGACACCGAGATCATTGC

CACGGTACGGAAATTCGTCCAGAAGGAAATCTTTCCCAATGCACCGGCCCTCGAACGTGGCAACAGCTACCCGCAAGA

AATCGTCAATCGGCTGGGTGTTATTGGCTTGCTCGGTCGCCGGCTGCGAGGGTTTCTACACCACCGAGTTCATTCTCG

GGCGTGCCGGCGCATTCGAACTGGCGGTGCGCGCTG

:::::::::::::Rv201T7.seq:::::::::::::
GCACCGGCGTCCTGCAGTTGGTAGGCCTGCAGTTTGTGCATCAGGCCGATGCCGCGGCCCTCGTGGCCACGCATGTAC (SEQ ID NO. 199)

AGCACCACGCCGCGCCCCTCACGGGCGACCATCGCCAGCGCGGCGTCCAGCTGAGGCCCGCAATCGCAGCGGCGTGAC

CCAAACACATCGCCGGTCAAGCACTCCGAATGCACCCGGACCAGCACGTCTTCACCGTCGGCGTTGGGCCCGGCGATC

TCGCCGCGGACCAACGCGACATGTTCCACGTCCTCGTAGATGCTGGTGTAGCCGATGGCGCGAAACTCCCCANGACAA

GTCGGAATCCGCGCCTCGGCGAACCGCTCAATGTGCCTCTCGTGCTTGCGCCGCCATTC

Clone Rv204
:::::::::::::Rv204SP6.seq:::::::::::::
TGGTCCGTGTGCGCATACCAATACAACGCGCCGGGCACCTGACGCGGCGGCCGCAACCAATCGGTGGCCATCGCCATC (SEQ ID NO. 200)

TTCTGCTACCCGGTCAACGGACGCACCTTCTCCTGGCCGACGTAGTGCGCCCACCCGCCGCCGTTGCGTCCCATCGAT

CCGGTCAAC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv205
::::::::::::Rv205SP6.seq::::::::::::
GGCGTGTTGGCCACCGGGGCCACTCCGCACAATCTGTACCCGACCAAGATCTACACCATCGAATACGACGGCGTCGCC (SEQ ID NO. 201)

GACTTTCCGCGGTACCCGCTCAACTTTGTGTCGACCCTCAACGCCATTGCCGGCACCTACTACGTGCACTCCAACTAC

TTCATCCTGACGCCGGAACAAATTGACGCAGCGGTTCCGCTGACCAATACGGTCGGTCCCACGATGACCCAGTACTAC

ATCATTCGCACGGAGAACCTGCCGCTGCTAAAGCCACTGGCGATCGGTGCCGATCGTGGGGAACCCACTGGCGAACCT

GGTTCAACCAAACTTGAAGGTGATTGTTTACCTGGGCTACGGCGACCCGGCCTATGGTTATTCGACCTCCCCGCCCAA

::::::::::::Rv205T7.seq::::::::::::
CGTCCGTGNCCCCTCAANCGCGTGNNGCCGAAGCGGCTGGTTACGACTCCCTGTTTGTGATGGACACTTCTACCAACT (SEQ ID NO. 202)

GCCCATGTTGGGGACGCCCGACCAGCCGATGCTGGAGGCCTACACGGCCCTTGGTGCGCTGGCCACGGCGACCGANCG

GCTGCAACTGGGCGCGTTGGTGACCGGCAATACCTACCGCAGCCCGACCCTGCTGGCAAAGATCATCACCACGCTCGA

CGTGGTTAGCGCCGGTCGAGCGATCCTCGGCATTGGAGCCGGTTGGTTTGAGCTGGAAACACCGCCAGCTCGGCTTCG

AGTTCGGCACTTTCAGTGACCGGTTCAACCGGCTCGAAGAGGCGCTACAGATCCTCCAGCCAATGGTCAAGGGTGAGC

GCCCAACGTTTTTCGGCGATTGGTACACCACCGAATC

Clone Rv207
::::::::::::Rv207SP6.seq::::::::::::
CCGCTTCCGTGTAACCGAGCANNGCGAGCGANCTGGCGAGGAAGCAAAGAAGAACTGTTCTGTCAGATAGCTCTTACG (SEQ ID NO. 203)

CTCAGCGCAAGAAGAAATATCCACCGTGGGAAAAACTCCAGGTAGAGGTACACACGCGGATAGCCAATTCAGAGTAAT

AAACTGTGATAATCAACCCTCATCAATGATGACGAACTATCCCCCGATATCAGGTCACATGACGAAGGGAAAGAGAAG

GAAATCAACTGTGACAAACTGCCCTCAAATTTGGCTTCCTTAAAAATTACAGTTCAAAAAGTATGAGAAAATCCATGC

AGGCTGAAGGAAACAGCAAAACTGTGACAAATTACCCTCAGTAGGTCAGAACAAATGTGACGAACCNCCCTCAAATCT

GTGACAGATAACCCTCAGACTATCCTGTCGTCATGGAAGTGATATCGCGGAAGGAAAATACGATNTGAGTCGTCTGGC

GGCCTTTCTTTTTCTCAATGTATGAGAGCG

Clone Rv209
::::::::::::Rv209SP6.seq::::::::::::
TGACACCCAACAGAGGGCACTTAAGATGGCAATGCGGCCGCCTACCTGCACGTTTTCGCGATGTCAGAGGATGCCGAG (SEQ ID NO. 204)

GGAGAACAATGCGAGCACGGCCGCTGACNTTGCTCACCGCTTTGGCGGCGGTGACATTGGTGGTGGTTGCGGGCTGCN

AGGCCCGANTCNAGGCCGAAGCATATAGCGCGGCCGACCGCATTTCGTCTCGACCGCAAGCGCGACCTCAGCCGCAGC

CGGTGGAGCTACTGCTGCGCGCCATCACGCC

::::::::::::Rv209T7.seq::::::::::::
ACGGGCGACGCTGAGGTGGGCCCGCGGCTATTCATGCTGTCGTCCACGTCCAGCGACGCACTCCGCCAGACGGCCCGC (SEQ ID NO. 205)

CAACTAGCCACCTGGGTGGAAGAACACCAGGACTGCGTGGCGGCCTCGGATCTGGCCTACACGCTGGCGCGTGGCCGC

GCGCACCGGCCGGTGCGCACCGCGGTGGTTGCCGCCAACCTGCCGGAGCTCGTCGAGGGTTTGCGCGAGGTGGCCGAC

GGTGACCCCTCTATGACGCGGCGGTGGGACACTGTGATCTAAGACCGGTCTGGGTCTTCTCCGGGCAAGGGTCTCAGT

GGGCGGCGATGGGCACCCAATTGCTCGCCAGCGAACCAGTGTTCGCGGCCACCATCG

Clone Rv20
::::::::::::Rv20SP6.seq::::::::::::
ATACTCAAGCTTCGCGAGATCCGGATGGCACTCACGCTGGACAAGACCTTCACAAAATCTGAAATCCTGACCCGATAC (SEQ ID NO. 206)

TTGAACCTGGTCTCGTTCGGCAATAACTCGTTCGGCGTGCAGGACGCGGCGCAAACGTACTTCGGCATCAACGCGTCC

GACCTGAATTGGCAGCAAGCGGCGCTGCTGGCCGGCATGGTGCAATCGACCAGCACGCTCAACCCGTACACCAACCCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GACGGCGCGCTGGCCCGGCGGAACGTGGTCCTCGACACCATGATCNAAAACTTCCCGGGGAGGCGGAGGCGTTGCGTG

CCGCCCAGGGCGAACCGCTGGGGGTTCTGCCGCAGCCCAATGATTGCCGCGCGGCTGCATCGCGGGCGGCGACCGCCA

TTCTTCTGCGAATACGTCCAGGAGTACTGTCTCGGGGC

::::::::::::Rv20T7.seq::::::::::::
AGCTTATGTGGCCGCCCACCTACCTTATCTAGCCTAGCTAACTAAATCCAGTGCCGACAGTGCGCGGCTGGCCACCCA (SEQ ID NO. 207)

GCATGAGGTTATGACCACGGCATATGCCAGCGCGCTGGCGGCGATGCCGACGCTGACCGAGTTGGCCGCTAATCACAC

CAGCCATGCGGTGTTGCTGGGAACGAATTTCTTTGGAATCAATACGATCCCGATCGCGCTCAATGAGGCCGACTATGC

GCGGATGTGGATTCAGGCGGCCACCACGATGAGTATCTATGAGGGCACCTCCGATGCGGCGCTGGCGTCNGCACCGCA

AACCACACCGGCTCCGGTACTGTTCAACGGCGGTGCTGGCGTTTGCCAGCGCCTGCCGGCGATCTC

Clone Rv214
::::::::::::Rv214SP6.seq::::::::::::
ATACTCAAGCTTGCCACCCATGCCGAGCAAGGTCGACTCAGCGATGACGAATTGTTCTTCTTCGCGGTGTTGCTGCTG (SEQ ID NO. 208)

GTTGCGGGCTATGAGAGCACTGCTCATATGATTAGCACNTTGTTTCTGACGCTGGCCGACTATCCAGATCAGCTGACA

CTCCTTGCGCAGCAACCAGACCTGATCCCGTCGGCGATCGAGGAGCACCTCCGCTTTATATCGCAATCCAAAACATCT

GCCGCACAACGCGCGTCGACTATTCGGTCGGTCAAGCGGTCATCCCGGGA

::::::::::::Rv214T7.seq::::::::::::
CCGGGGTAGAACGATGCGATCTGGGCCATGTCGACATCGGTGGTACAGGTAAACCGCGCCGTGTGCGCGGTCTCGGAG (SEQ ID NO. 209)

ATCAGAACGTGGTCGCAGTTGACACCGCGGGCTTTCAGCCAGTCGCGATAATCGGCGAAGTCGGCGCCTGCCGCCCCA

ACTAGCGCGACCTCGCCACCTAGCACACCGATGGCGAAGGCCATGTTTCCGGCCACGCCGCCGCGGTGCATCATCAAC

TC

Clone Rv215
::::::::::::Rv215SP6.seq::::::::::::
ATACTCAAGCTTGGCGGCAACGCCACTACCGGGCTCACCAGGTCCTGTGCCGCCACCGCCGGCGCCGAAAGCACCATC (SEQ ID NO. 210)

AGGTCGTAGTTGTCTGGACGTTCGACACCGTAAGCGAACACAATGCCGCCGCCCATGCTGTGCCCGAGCACGATGCGC

TTGCACCCGGGATATTCCCGGGTGGCGATCCCAACGAGGGTGTCGAAGTCAGCGGTGTATCTGAGATGTCTCTCACTA

TCATCCGTTTGGCACCCGAGCGGGCATGCCCGCGGGGGGTCAAC

::::::::::::Rv215T7.seq::::::::::::
GTCGACGGCATCAAGGTCCGCAGTGATGGTGTTCATCTCACCCAGGAAGGCGTGAAGTGGCTGATACCGTGGCTTGAG (SEQ ID NO. 211)

GATTCGGTGCGGGTCGCCAGTTAATCCGCCGTGTGCTCCGGATGAGCGCGACGGTAACCCTGGAATTGTGCTGTGTGC

TGGCTGTGTCGTTGTGATGAGCCTGTCTAAGTGGTGCGTAACCGTTTGACGAGCCGCGGCCTCGCTGCAAACATTGAA

GCCCGCACGTCTGGGTTTGTATTTACACAACGAGGGCGCTCCCCGATCTGGCGCGCGCAACGAGGTGCNCACTATCCA

TTCGAGGTGAACTGGACTCCTTGATGCTCATGCCGGTGCGGTTTTGTC

Clone Rv217
::::::::::::Rv217SP6.seq::::::::::::
ATACTCAAGCTTGCGTTCGATGAAGTAGTCGTCGGTCAGCGCCGCCTCTTCGAGCTCCTTGGCGATGCCCAGCAAGGA (SEQ ID NO. 212)

GTCATCGCCGCCGAGCTTGGCCAGGATCTTGTCGGCCTGTTCCTTGACGATGCGGGCCCGCGGATCGTAGTTCTTGTA

GACACGATGACCGAAACCCATCAATTTGACCCCGGCCTCGCGGTTCTTGACCTTGCGTTACAAACTCGCTGACGTCGT

CGCCGCTGTCGCGAATGCCCTC

::::::::::::Rv217T7.seq::::::::::::
NGTCAAGCCGAGCATGCGCGAGGNAACGACGAACCCAACAAGCCATGGTGGTTGGCGCCGTCGAGAGGTCGGCGGTCG (SEQ ID NO. 213)

CCACAACGGGAAGATCGCCTTGAGCGTCGCTCGACCGCCGCCTCGAGTTGGGTCATAACGAAGTAGCTGATGCCGATC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

ATGTCGACGTTTCCGTCGCATCAGCGTGCAGCGGCGACCCACTCGACGAGGTCTCGGTGCCGCCGCGGCCAGGGGACC

AGCAGTGACGATTCCAGGCGCCGTCGGG

Clone Rv218
::::::::::::Rv218SP6.seq::::::::::::
CGATAATCGCTTCCGGTAAGTGCAGCAGCTTTACGACGGCGACTCCCATCGGCAATTTCTATGACACCAGATACTCTT (SEQ ID NO. 214)

CGACCGAACGCCGGTGTCTGTTGACCAGTCAGTAGAAAAGAAGGGATGAGATCTCCCCGTGCGTCCTCAGTAAGCAGC

TCCTGGTCGCGTTCATTACCTGACCATACCCGAGAGGTCTTCTCAACACTATCACCCCGGAGCACTTCTAGAGTAAAC

TTCCCATCCCGACCACATATAGGCTAAGGTAATGGGCATTACCGCGAGCCATTACTCCTACGCGCGCAATTAACGAAT

CCACCATCGGGGCCGCTGGTGTCN

Clone Rv219
::::::::::::Rv219SP6.seq::::::::::::
NAATACTCAAGCTTTCTCGTGATTACCACCCGTGTAATTTGGGATGGGCAAAAAGGCGAATCACCGCGTGGCCACAAA (SEQ ID NO. 215)

CGCCGGGAGGGACAATCTCGGGCGGCTAGGGCTTCTCGCGGGAAGGCCCGAACGTACGGCGTTTCAACACGTCGCGTC

GCCCTCCGACCGCGAACATTCGGGGATGGCAGCAACCTGGTATCACCCTGGCCGGGCAATGATCTGCAGCGTCGCCGC

GGGTAGTGNCCGCCCGGGCGGCTAC

::::::::::::Rv219T7.seq::::::::::::
CCAACTAGAGCATCGGGACATACGGAGTCAACTACCCGGCCAACGGTGATTTCTTGGCCGCCGCTGACGGCGCGAACG (SEQ ID NO. 216)

ACGCCAGCGACCACATTCAGCAGATGGCCAGCGCGTGCCGGGCCACGATGTTGGTGCTCGGCGGCTACTCCCAGGGTG

CGGCCGTGATCGACATCGTCACCGCCGCACCACTGCCCGGTCTCGGGTTCACGCAGCCGTTGCCGCCCGCAGCGGACG

ATCACATCGCCGCGATCGCCCTGTTCGGGAATCCCTCGGGGCCGCGCTGGCGGGCTGATGATCGCCCTGACCCCTCAA

TTCGGGTCCAAGA

Clone Rv21
::::::::::::Rv21SP6.seq::::::::::::
ATACTCAAGCTTGCTGCAGCTTCCTGTGACTGCTCCCGAAACCTGGGGGTGTGCCTGCTGTGTATGCACGGCATACGG (SEQ ID NO. 217)

ACATCCTTCCCCTGAGACCCGCGGTCGAACCAGCCACGTGTCCATCATCAGGGGTCAACCCCGGCCAAGGGCGACGGC

ACGCCAAGTTCGCCGACCGTTAACCTAGTGCTGTTAGCTTCATTTGCTGCGAGCAAAACAGCTGGTCGGCCGTTAGGA

ACTGAATTGAAACTCAACCGATTTGGTGCCGCCCGTAAGTGTCCTGGCTGCCGGTGCGCTGGTGTT

::::::::::::Rv21T7.seq::::::::::::
AGCTTGCGCGGCGTGGCGATCGCGGTTCAAGGCGCGCTCTTCGAGCACAACGAGCGAAGACAGCTCCGCGACGGAGCC (SEQ ID NO. 218)

TTTATCGACATCCGTTCGGGCTGGCTGACCGGCGGCGAAGAACTGCTGGACGCGTTGTTGTCGACGGTGCCGTGGCGA

GCCGAGCGCCGTCAGATGTACGACCGGGTGGTCGATGTGCCGCGGCTGGTGAGTTTTCACGACCTGACCATCGAAGAT

CCGCCGCATCCGCAGCTGGCGCGGATGCGCC

Clone Rv220
::::::::::::Rv220SP6.seq::::::::::::
AATACTCAAGCTTGCGCACGACCAGGACGTCGAGTGGCGCTTGCAGTGACTTGGCGACCTCAAAGGCCACCGGTACCC (SEQ ID NO. 219)

CGCCGCGCGGCAAGCCAAGGACNACNACGGCCTTGCCGGATAGCTGCGCCAGGCGTTGCGCCAACTGGCGTCCAGCGT

CGCCACGATCGTCAAAGAGCTTCATCTGCCGAGTGTGTCGCCATCTCATGGCTCCAAATATGGAATTAGGTCCCTGGG

CCGACTGACGACAGTCCCTCAGCGACCGGATTGCGCATCCCGCCTTGTACGCTGCTCCGCAAATCCCGGGCTTGCCTC

CGCGGAAGCGAACTCGGCGGCGCTACGGTGGTGGCTCACTTCGGCCGTGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv220T7.seq::::::::::::
GGTTGGTGCGGTCCACCTTCGCGGCGGCGGCGCGATATGCCTTGCTGGTCTTGCTCATTTGATATCCAATCTATGGGT (SEQ ID NO. 220)

CGTGGTTACTCAGCGGGCCGAAGCTGGCCCTCCCACGGGTAGGGCCCTATTCGACGGTGATGCCCATCGACCGAGCGG

TACCGGCGATGATCTTGGCCGCAGCGTCGACGTCGTTGGCGTTGAGGTCCGTCTTCTTGGTCTCGGCGATTTCGCGGA

CTTGATCCCAGGTGACTTTGGCGACCTTGGTCTTGTGCGGCTCCGCCGAACCCTTCGCCACACCAGCGGCCTTAAGCA

GCAGCTTGGCGGCGGGCGGCGTCTTCAGCGTGAAAGTGAAGCTACGGTCTTCATAAACGGTGATCTCCACCGGGATGA

CGTTGCCGCGCTGGTTCTCCGTCGCGGCGTTGTACGCCTTGCAGAACTCCATGATGTTGACCCGTGCTGACCGAACGC

GGGGCCCACTGGCGGGGC

Clone Rv221
::::::::::::RV221SP6.seq::::::::::::
ATACTCAAGCTTTTCGACCCGCAAGCCGGCGGTGCCCCTCCTCGTTCCGCTGCCCGGTCTGCTCGATCGGTTCGGGGT (SEQ ID NO. 221)

CGCCGCGCTAGGCCCAATTGCCCGGCTCCTCCTCGGGCCGTTCCACAACCCGCATCGTCGCCGGGCTAGGTTCAACCC

ATGCCGGTAAACCCCAGGACGCCAGTGCTGATCGGCTATGGACAGGTCAACCACCGAGGCGACATCGACGCCNAAAAT

CAGTCCATCGAACCCGTCGACCTGATGGCCNCCGCGGCCCGGAAAGCCGCCGAGTCCACCGTGCTCGAAGCGGTGGAT

TCCATCCGTGTGGTGCACATGCTGTCGGCGCATTACCGGAATTCCCGGGCGTCTCCTCGGC

::::::::::::Rv221T7.seq::::::::::::
NCCTGGTTCATGAACTGGAAGCAGCGCAGCGCTTCCTTTTCGGCCGCAACATGAGCCAGCCTCTCGTCGGCGGTCGGC (SEQ ID NO. 222)

TGCAGGTGCTCGGGCAGCTCGGCCGCGACAGCCGCCTGACCCTGAAACCAGCTTCCATATCCCGCGACGAACGACGCC

AGTCCGCTACGTAACCCCTCCGCGACTGTCCATGGACAACAGCGCGTTCTCCACCGACCGGGGCCGGGTGTTGGGGTG

TTCGGCAACGGCAACCAAGTTGGTCCACACTGCCGACGGGCGCCGCAAATCCGTTCACCGAACCAGGCCGCCNAAACA

ATTCCGCCCGATCCCATAT

Clone Rv222
::::::::::::Rv222SP6.seq::::::::::::
ATACTCAAGCTTGTCGGGATCAATCTCGAGGGCATCCACGCACGAAAAGTAAACTCTATCAAGCTTTTTGACGACACC (SEQ ID NO. 223)

CACGGACGCCCCATATATGTTCGGGTGGGCAAGAACGGTCCCTACCTGGAACGTTTGGTGGCCGGCGACACCGGTGAG

CCCACGCCGCAGCGGGCCAACCTCAGCGACTCGATTACCCCGGACGAACTGACTCTACAGGTGGCCGAAGAGCTCTTT

GCCACACCGCAACAGGGACGGACTTTGGGCTTGGACCCAGAAACCGGCCACGAAATCTTTGCCAGGGGAAGGCCGGTT

TGGGCCTTATGTTACCTATATCCTGCCGGAACCTGCGGCTGATGCGGCCGCGGCCGCTCAGGGAN

::::::::::::Rv222T7.seq::::::::::::
AGCAGCTAGCCGCGCTCGCCGCGCTGGTCGGTGCGTGCATGCTCGCAGCCGGATGCACCAACGTGCTCGACGGGACCG (SEQ ID NO. 224)

CCGTGGCTGCCGACAAATCCGGACCACTGCATCAGGATCCGATACCGGTTTCAGCGCTTGAAGGGCTGCTTCTCGACT

TGAGCCAGATCAATGCCGCGCTGGGTGCGACATCGATGAAGGTGTGGTTCAACGCCAAGGCAATGTGGGACTGGAGCA

AGAGCGTGGCCGACAAGAATTGCCTGGGCTATCGACGGTCCAGCACAGGAAAAGGTCTATGCCGGCACCGGGTGGACC

GCTATGCGCGGCCAACGGCTGGATGACAGCATCGATGACTCCAAGAAACGCGACCACTACGCCATTCAAGCGGTCGTC

GGCTTCCCGACCGCACATGATGCCGAAGAATTCTACAGCTCCTCCG

Clone Rv223
::::::::::::Rv223IS1081N1400.seq::::::::::::
CGCGACTGGCTCCCCGGNCGGCTGCTCGGGTCCGCCGATAGAGACCGGGATCTCGCCCGACGACGGGCAGCCGGGTTG (SEQ ID NO. 225)

CGTGGGACGGGGCGGGGGTCGGGCAGCCCAAGCAACGGGCTAGTCCCCGAATCCTACGGAGCCGTCACCTACGCCTAC

GTAATAGTAGCTATCAATAACAGTTGACATACGCAACGATCTGTGAGATCAATATTGCCTGACGCATGTCAAGACAGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGTCAAGACAGGTGTCAATAATTCGCTCCGCTGGTGACGGTAACCGGTCGTGCGGGTGTGTGACGCCTAAGGAAGGAG

TGTGGGTGGTGACGCTGAGAGTGGTTCCTGAGGGTTTGGCGGCCGCCAGTGCGGCGGTGGAGGCGTTGACCGCACGGC

TGGCCGCCGCACACGCTGGCGCGGCGCCGGCGATTACGGCGGTGGTGGCGCCCGCGGCGGATCCGGTGTCGTTGCAGA

ATGCGGTGGGGTTTAGCGCCTTAAGTAGCCAGCATGCCGCGATCGCCGGCGAAAGGGTCCAAGAACTGGGT

::::::::::::Rv223SP6.seq::::::::::::
ATACTCAAGCTTATTGAACCGCGGGTCGCAGGCAAAGTGGACCTCATAACGACTCGGGTCCAGCGACCGCGCCAACAC (SEQ ID NO. 226)

GAACGGCCGGACGACGTGGGCCAGGGTCGCGGCCTCCCCTACAAACAGGATCCGTTGCCTGCGAACGACAGGCTCCGG

TGCGGCGTTGGGCGCCGTGCTCGTCCCAGCGTCCGGTCCCGGGTCGCCGGCGACGCTTGTTTCCTCCATACTCGCCCC

CTAATCTCGAGGCAGCCCGTACCCGCAGGCAACCTCCCAAAAATGCAATCCCGCAAAATGCAATGCGTCNAGCTATTT

CTCACACCGACCGCTAGTTGCGGATCAGAAATCCGTTGGGCGCGGAAGTCCAGCCGAATTTGTTCTCCCGCTCCGCAT

CATGCTTGTAATCGTTTGGAAATTCATCCTCATATGCCTCGATCGCTTCATAGGGTCCAGGCCCAAACCCGGGCAGGA

CTGGGTGGCCGTTGATGTTGGAATCCTCCACTACTAGGTATTCACCGGC

::::::::::::Rv223T7.seq::::::::::::
GTCTCGATCATGGCCAAAGAGCTCGACGAAGCCGTAGAGGCGTTTCGGACCCGCCCGCTCGATGCCGGCCCGTATACC (SEQ ID NO. 227)

TTCCTCGCCGCCGACGCCCTGGTGCTCAAGGTGCGCGAGGCAGGCCGCGTCGTCGGGGTGCACACCTTGATCCCCACC

GGCGTCAACGCCGAGGGCTACCGAGAGATCCTGGGCATCCAGGTCACCTCCGCCGAGGACGGGGCCGGCTGGCTGGCG

TTCTTCCGCGACCTGGTCGCCCGCGGCCTGTCCGGGGTCGCGCTGGTCACCGGCGACGCCCACGCCGGCCTGGTGGCC

GCGATCGGCGCCACCCTGCCCGCAGCGGCCTGGCAGCGCTGCAGAACCCACTACGCAGCCAATCTGATGGCAGCCACC

CCGAAGCCCTCCTGGCCGTGGGTGCGCACCCTGCTGCACTCCATCTACGACCAGCCCGACGCCGAATCAGTTGTTGCC

AATATGATCGGGTTCTCGAC

Clone Rv224
::::::::::::Rv224SP6.seq::::::::::::
ATACTCAAGCTTTCGTCAGTTCATGGCGCCAGCAGACCAACAAGAGCATCGGGACATACGGAGTCAACTACCCGGCCA (SEQ ID NO. 228)

ACGGTGATTTCTTGGCCGCCGCTGACGGCGCGAACGACGCCAGCGACCACATTCAGCAAATGGCCAGCGCGTGCCGGG

CCACGAGGTTGGTGCTCGGCGGCTACTCCCAGGGTGCGGCCGTGATCAAGATCTTCACCGCCGCACCACTGCCCGGCC

TCGGGTTCACGCATCCGTTTGGCCGCCGCC

::::::::::::Rv224T7.seq::::::::::::
GCCCCGTGTAATTTGGGATGGGCAAAAAGCGAAGCACCGCGTGGCCACGAACGCCGGGAGGGACAATCTCGGGCGGCT (SEQ ID NO. 229)

AGGGCTTCTCGCGGGAAGGCCCGAACGTACGGCGTTTCAACACGTCGCGTCGCCCTCCGACCGCGAACATTCGGGGAT

GGCAGCAACCTGGTAGCACCCTGGCCGGGCGATGATCTGCAGCGTCGCCGCGGGTAGTCTCCGCCCGGGCCGC

Clone Rv225
::::::::::::Rv225SP6.seq::::::::::::
ATACTCAAGCTTCCTTTGACCGAACGCGTCCACCGCACCGTGAGATTGGTGGCGCCATTCGTCGTGGTGTAGCTGCTG (SEQ ID NO. 230)

TTGGCGGCGTCGCCGTATTGTGCGGGCCAGCCTTGTGCGGGGGCCGCTTCTACCCACAAGTCGGCACTTCCGCAACCG

CCCAGCTCGACCGCGAATTACGGCGGCCGCAACGGCCGCCGGAAGGCGTCACGCAATCGCTTATCCTTTCCAGGTTCC

CAAATCCTCCGCTTACTTGGGTCCTTCATCGG

::::::::::::Rv225T7.seq::::::::::::
GGCAGCGGCGACAACCGGAACGTCCGCACGGTGCTCAATCACGGGTGCACGGTGTGCATCAGAATGGCGGGGGTTCGT (SEQ ID NO. 231)

TGTCGCGGTGAGGCGTTCGGCGAGGAGGTAGTGTCTACCCCTTGCCCGCGGGTTCGTGCGGACTGAAAGGGATTTCAT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TGGGAACCCACGGCTGCGTATCGCAGGGCCTCGGTGACGTCTGCTTCCTCNAGCTCAGGAAGTTCGGCGAGAATCTCG

GTGGATGTTATTTGGTCCGCCTAC

Clone Rv226
::::::::::::Rv226SP6.seq::::::::::::
ATACTCAAGCTTTCTCGGCTTCTCTGATAGCCTGAGAAGAAACCCCAAGTTAATCCGCTGCTTCACCTATTCTCCAGC (SEQ ID NO. 232)

GCCGGGTTATTTTCCTCGCTTCCGGGCTGTCATCATTAAACTGTGCAATGGCGATAGCCTTCGTCATTTCATGACCAG

CGTTTATGCACTGGTTAAGTGTTTCCATGAGTTTCATTCTGAACATCCTTTATTCATTGTTTTGCGTT

Clone Rv227
::::::::::::Rv227SP6.seq::::::::::::
ATACTCAAGCTTGGTGACCGGCACCGCGATACGTTGCGGCAGGCATCTGGGCTGGCGGTGGTTCGCCGCTCCGAAGCC (SEQ ID NO. 233)

GTCGAACACCATCGCCAGCGCGGCTTCCACATCAACGACCATTTCGGCCAGCTTGCGGCGCATCAGCGGCTTGTCGAT

GAGCGCCCCACCGAATGCCCGCCGCTGCCCGGCGTATCACATCGATTCGACCATCGCGCGGCGCGCGTTGCCGAGGGC

GAACGAGGCGGTGCCCAACCGCAATCTGTTTGGTCAGCTCCCTCATGCGGGTTGATTCCTTGCCGTCCGGACGGGCCC

GCGTCATGCGCTCGGTTCGCC

::::::::::::Rv227T7.seq::::::::::::
CCGTTGCGCAGCGTGAGCCGATAGTTGACATCCGGCTCGGTGAAGGTGAAATCGATGGCCAGGTCGAGGTCCCATGCG (SEQ ID NO. 234)

CGTGGGCCATTGATGCTGATCGCCAGGACGTCAAAGATTTGGTCCGGCGTCAGCTGGGCGAAAAACGTGGGCGCCGGG

ACTTGCCCGGAGCTGCCCGGGTTCCCGTCGCGCAGCTCGGCGGCCCCGGTCAGAAAGAAATTGCGCCAGGTCGCACAC

TCCGCGCCGTAGGCCAGCTGCTCCAGGGTGTCGGCATAGAGCCCGCGGGCCGCAGCGTGCTCGCTGTCGGCGAACACC

GCATGGTCGAGAAGCGTTGCCGCCCAACGGGAAATCACCTGCGTCGAAAGCTTCGCGGGCCAGCTCCAGCACTCGGTC

GATGCCACCCAACGCGT

Clone Rv228
::::::::::::Rv228SP6.seq::::::::::::
ATACTCAAGCTTGCGGATGTTACCCCTGACAGCGTGAACTATGTCNAAACACACGGCACCGGAACGGTGTTGGGGGAC (SEQ ID NO. 235)

CCCATCGAGTTCGAGTCGCTGGCGGCCACTTATGGCCTGGGTAAAGGCCAGGGCGAGAGCCCGTGCGCATTGGGGTCG

GTCAAAACCAACATCGGCCACCTGGAGGCGGCCGCCGGTGTGGCTGGATTCATCAAGGCGGTGCTGGCGGTGCAACGT

GGGCACATTCCCCGCAACTTGCACTTCACCCGGTGGAACCCGGCCATCAACACGTCGGGGACGCGGCTGTTCGTGCCG

ACCGAAAGCGCCCCGTGGCCGGCGGCTGCCGGTCCACGCAGGGCTGCGGTGTCATCGTTCGGCCTCAGCGGGACCAA

::::::::::::Rv228T7.seq::::::::::::
CCGGTAACCAGATCAGCTCGTCGACCTCACTGCCGGGGGTGAATTCCCCACCGCTGCTGCGCGCTCCCCAGTAGTGCA (SEQ ID NO. 236)

CCTTCTTGACGCCTCGAAAAGGGGAGTCCGTCGGGTAGGTCACCGTCAGGAGCCGCCTACCCAGGTTGGCGCGGTGAC

CGGTCTCCTCGAGTATCTCCCGCACCGCCCCCACCGGTGCGGTCTCGCCCGGATCCACTTTGCCCTTGGGCAGCGACC

AGTCGTCGTAACGGGGGCGGTGAATGACAGCGATCTCGACCGGCCCTTCCGAATCGGCACTGCCGGGTCGCCAGAACA

CCGCACCGGCGGCGTACACAATCCGGCCCGCCCAGCGCCGGCGGGCGGACGANTTCTGGATCGACACCTCAACTCCTG

CAGGTCAATTCGGCCAAGCTGCTCGCGGTCGTGGATGTGGTC

Clone Rv229
::::::::::::Rv229SP6.seq::::::::::::
ATACTCAAGCTTGATGCCGCCGAAACCGAGCGTGAGCACGCCGCCACCCACCACGCGCGGGTCGGGCGCCGGGCCCGG (SEQ ID NO. 237)

GCCGCCAGGCTGCTCCGCTCGGTGATGGCACGCCACCGCGACACCACCCGGCTGCGCTACGTCGAGCCATACCGGGCG

GAGCTACATCGGCTCGGCCGCCCAGTGTTCGGGCCCTCTTTCGAGGTCGAGGTCTATACCGATTTGCGCATCCGCAGC

CGCACCCTGGTCGTCTCGTACCGTGCCCTACCTCTGCTTGTCGGGCGGGGCCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv229T7.seq::::::::::::
TCCGTACGGCCCGGGTACGCTTCGGTCGCAGTGTGCGAGTGATAGATGACGACCGGGACCTCGTCGGCATCTTCCATA (SEQ ID NO. 238)

GCCCGCCACACCTTCAGTTGCTCACCGGAATCCAACCGGTAGAAGGTCGGCGAGCGCTCGGCATTGGTCATCGGGATA

TGCCGCTCGGGACGGTCAGAGCCCTCGGGTCCGGCCAGCACTCCGCAGGCTTCGTCGGGGTGGTCGCGACGCGCATGG

GCCACCATCCATCCACCAGGTCTGCGCGAATCACCCGC

Clone Rv22
::::::::::::Rv22SP6.seq::::::::::::
GGACACATTGCGAACATTGATGACAAAATAGAAATCATTGATGGTTTGAGTCACCAGGCCGATCAAGCCTTCGCCGAG (SEQ ID NO. 239)

CCAAATTCCAATCAAGAGGCCCAAGCCCGTACCAATCAGCCCGGCAACGAGGGATTCCGTCATTATCAGCCAAAATAA

CTGCTCTCGGGTTACACCCAAACAGCGCAATATGGCGAAAAACGGTCGCCGTTGCACGACATTAAATGTCACGGTATT

GTAAATTAAAAAGATACCCACCAACAAGGCAATCAAACTGAGAGCGGTTAAATTGACCGTAAAAGCGTCCGTCATCTG

TTTGACGGTGTCCCGTTGGGTNTCCGACGTTTCCATACGCACACCGGCCGGCAGTCTTTGTTGGATGCGTGTTGCAGT

GGCCTCATCTTTGATGATCA

::::::::::::Rv22T7.seq::::::::::::
GCCTGGCCCAGGTGAAGGCCGACCTCGACGCCAAAGCCGCTGATCCGGCACATGAGTCGGTGGACTGGGACTTGAAGT (SEQ ID NO. 240)

CGCTGCGATGGGCGTGGAACCGAGCCAAAGATGACGTGGCGCCGTGGTGGGCCGAGAATTCCAAGGAGTGCTACTCGT

CGGGGTTGGCCGATCTGGCCCAGGGCCTGGCTAATTGGAAAGCTGGCAAGAACGGGACCCGCAAAGGCCGGCGGGTGG

GCTTCCCGCGATTCAAATCCGGGCGGCGTGATCCTGGCAGGGTGCGGTTCACCACCGGCACCATGCGCATAGAGGATG

ACCGGCGCACGATCACGGTCCCGGTGATCGGGCCGCTGCGGGCCAAGGAGAACACCCGCCGGGTGCAACGCCACCTCG

TGAGCGGGCGCGCGCAGATCCTGAACATGACCTTGTCGCAGCGGTGGGG

Clone Rv230
::::::::::::Rv230SP6.seq::::::::::::
TAACTCAAGCTTCAAGTCCGCNGTCCGACCCTGTTCGACGGCTACCTGAATCAACCCGATGCCCCGCCGCGGCGTTCG (SEQ ID NO. 241)

ACCCGACAGCTGGTACCGCACCGGCGACGTCGCGGTGGTCGACGGCAGTGGGATGCACCGCATCGTGGGACGCGAGTC

GGTCGACTTGATCAAGTCGGGTGGATACCGGGTCGGCGCCGGTGAAATTGAAACGGTGCTGCTCGGGCATCCGGACGT

GGCGGANGCGGCAGTCGTCGGGGTGCTCGACTATTATCTAGGCCAGCGGATCGTTGCCTACGTAGTCGGCTCAGCGAA

TGTCGATGCGGACGGGCTTATCAACTTTGTTGCCCAACAACTTT

::::::::::::Rv230T7.seq::::::::::::
CCATGTCGCCCAACATATCGTCGATGTTCGCGTCGTCCGCCTCGCGCACGTGGTCTGTCACCAGTCAACGTTAACGCC (SEQ ID NO. 242)

GCCGCACATGTCCTGCGGCCGGGCAAAAACGTGAAAAACGAGCGGGCGACTGCAATGTCATGACACCGACGCCGCCGA

TGGGCCCAGGGTCTGGCAGATTCGATCTGTGCGGCCAGTGCCAGCAGCGTCGCCTCGTCATACGGCCGGCCGACGAGT

TGAACCGACATGGGCATGCCGTCGCCGTCGAAGTCCCACGGCACCACGGCCGCGGGCTGGCCGGTCAGATTCCANACT

TGAAAGTACTGAAGCCGCTGCACCACCAG

Clone Rv231
::::::::::::Rv231SP6.seq::::::::::::
CGAAAGCGTGAAACAGCTCGCGGCAGCCCCCGACGTGCTGCGTCGGATAGCCGGCGGGCGAAGATCAATTCCAGGCAG (SEQ ID NO. 243)

CTCCCGGACAATGCGGCTCTGCTGGCCCGCAACGAAGGACTCGAGGTCACCCCGGTGCCCGGGGTCGTGGTGCACCTG

CCGATCGCACAGGTTGGCCCACAACCGGCCGCTTGATGCCCGGTCGGCAAGCCCGGCAGTTGCCAAACCCAGCGTGAT

CNTGCTCNGCTCTNTANTTCGGCGAAGAAGTGGCTCGCCTGATCACCTACCATCGGCCAGGATCTGCGTGTCATCACA

ACGCTCGCCAAGGAGGTTGTTGTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv231T7.seq::::::::::::
TCCGCCACGCTTCGCGCCGCCCGGCATACGGCGCGTACCGATCTCCGCGTCATACACCGCGGGTAATCGCCGACGGTG (SEQ ID NO. 244)

CCGGTTCGCGAGCCGAAGGTGACGACGCTGATTGAATCGAGTTCCAGGTCCAGCGGGTGGCGCAGCAACGGCGCGAGC

TCAACGACGTCAATCACGTTGTCGCTTTCTACGGTCACCGACCCGGTGACCGTAGTCGCCCGGTGCGCTCGGCCGAGA

AGCTGCACCGCCACCACCGCGACACCGTCTTGCACGCGGACCCACCCCGGATCGGTTGTTGGCCAAGGTAATTGGGTC

ATTCCATTTGACGGGACGCCGACCC

Clone Rv232
::::::::::::Rv232SP6.seq::::::::::::
CATTCTTTAACAGTTGTTTTGGGCTCGGCATGGTTAGCCAACGTTCTGCGGTCCACCATATCATCTTGGTCCGGTAGC (SEQ ID NO. 245)

GCTCGTCCGGGGTATGCTGCCGCCGGGATTCTCGCTGCTATTACTCCCCCCGAAGAACCGCCACCGGTCCAGCGCGTG

GGCCGNCGCGGTCCCATCACAAACTGAACCCCCAACAGGGACATGCTTATCGGTAGGGCGCGCGCCAAGGCGGCAGCA

ATCGCATCACTGCGCTCTGCGCGTCACTATTAACCCACCCGGACTTCACTTCCACCACCCCGAATGGCGCCCGGTCAT

TGATCATCTGGCGCACCGCGGATAA

::::::::::::Rv232T7.seq::::::::::::
CGGTGTCCTGCAGTTGGTAGGCCTGCAGTTTGTGCATCATGCCGATGCCGCGGCCTCGTGGCCACGCATGTACAGCAC (SEQ ID NO. 246)

CACGCCGCGCCCCTCACGGGCGAACATCGCCAGCGCGGCGTCCAGCTGAAGCCCGCAATCGCACCGGCGTGACCAAAC

ACATCGCCGGTCAAGCACTCCGAATGCACCGGACCAGCACGTCGTCACCGTCGGCGTTGGGCCCGGCGATCTCGCCGC

GGACCATGCGCGACATGTTCCACGTCCTCGTANATGCTGGTGTAGCCGATGGCGCGAAACTCCCCATGACGAGTCGGA

ATCCGCGCCTCGGCGACCCGCTCAATGTGCT

CloneRv233
::::::::::::Rv233SP6.seq::::::::::::
CGGCATCTGGCGGCTGAACCTGTTCTTGGGCAACATGCCGAGGATCGCCTCTTCCACCACGCGGTCGGGGTGGCGTTG (SEQ ID NO. 247)

CATTACCTCACCGATGGTGCGCTTGTGCAGGCCGCCGGGATACCCCGAGTGCCGGTAAACCATCTTGTGCTGCAGTTT

GTCGCCGCTGATGGCGACCTTGTCGGCGTTGATCACGATNACNAATCACCGCCANCGACATTGGGGGCGAACGTCGGC

TCGTGCTTGCCGCGCAGCAGGCTGGCCGCCGCGACGCAAGGCGCCAACCACCACGTCCGTGGCGTCGATGACGTACCA

CCATCGCGTGGTGTCACCCGCCTTGGGC

::::::::::::Rv233T7.seq::::::::::::
GCGGCAAAAATTGAAGCACTCNTGGCCACTNCCGCCGGGAGGGACAATCTCGGGCGGCTAGGGCTTCTCGCGGGAAGG (SEQ ID NO. 248)

CCCGAACGTACTGCGTTTCAACACGTCGCGTCGCCCTCCGACCGCGAACATTCTGGGATGGCAGCAACCTGTTAGCAC

CCTGGCCGGGCGATGATCTGCAGCGTCGCCGCGGGTAGTCGCCCCCGGGCGGCTACAGTCTGAAACGCGATGACCATC

GATGTGTGGACGCCGCATCCGACNCAACGGTTCCTACACTGTGATATGTTCGCCTCGCTGCGCCGGTGGACGGTGGGT

CTATCCCGGA

Clone Rv234
::::::::::::Rv234SP6.seq::::::::::::
CGCGTTGAACTGAAGGGGTGCCGCCCGGCTCGAGCAGGCAAGCCATTTGTTCGATGCGGTTACCGAAGATCTCTTCGG (SEQ ID NO. 249)

TGACTGCCCGCCGCCGGCCAGCTCGGCTCAGTGTCCGGCGTTGGTCGCCCGCGGCGACAATCTTGGCGTCCACGGTGGT

CGGGGTCATGCCCGCGAGCAGGATTGGCGAGCGGNCGGTCAGCCGGGTGAACTTCGTCAAGAGCTGACGCTGCGGTTG

GGGAGGCGAATCATGGTCGGTGCGTAGCCTCGACTAGGCCCGGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv234T7.seq::::::::::::
TGACAACGCGGCGGCGATTACCCCGCTACCGCAGCAGCATGACGCGGTAGCGAACACCGCCGGATGCAGCGCAGGTGC (SEQ ID NO. 250)

GTCGATGTGCTCACGGAATCGCCCCGGCACCGCGATCTCGAGGATCACCAGTGCCACCCCCTGCAGCGCGACACCGAC

GATTCCGTACACCGCCACGCCGATCAGGCCCTGGGCCAGCTGATTGGAGCTGGCGTATATGGCGGCGATGGTGACGAT

GGTCATCGCCTCTTACATTGTGGCGGCCAGAACCACGGCGTTGGGGCGGCGGTCGATGAACACTAGGCGACCANATCC

CCGGGGTCAACAGGTTGACCATCC

Clone Rv235
::::::::::::Rv235SP6.seq::::::::::::
CGCGGACATCCCGAACGAGGACACGCGACCGCTTCGGTGTGTGATCTATCAGGGCTCGCACCACGCGCAACCGCTTCC (SEQ ID NO. 251)

GGCTACCTAGACGCGGT

::::::::::::Rv235T7.seq::::::::::::
GCATGCGGGTGATGCCGTTCTCAGTGCGCAACAGCGTTCGACGCGGCATACCCAGCCGCACATGCCGTGCACGCCGGN (SEQ ID NO. 252)

GCCGGGGCGGGAATCT

Clone Rv237
::::::::::::Rv237SP6.seq::::::::::::
CTCAAGCTTCAGNCCNTCTAAGCGGTCTGCGCGGCGATCGCAAAGATCGCCCTTTGCCGGCGTTGGGGGCTTCTGCTC (SEQ ID NO. 253)

GGGGGTGTTGTACACCTTCTCGAACACCTCGGCACCGACACCACCACCGTCGGCTTGAACACCGCCAACATCGGCAGC

ANATCTTGATGTCCTGGTGAATCCACGGTGACTTTGGAGTGGAAGGCGGCCATACTGATCGCGCGCGCCACCACATGA

GCTAGCGGCAGGAAAACCAGCAGCCGCTCACCCTTGCGCAGCAGCGTCGGGTGATATGCCTGGCGCCC

::::::::::::Rv237T7.seq::::::::::::
AGTCGAANGTCAGTCCGGTCTCCTCTCCGACTACGGCCAAGAACTGGGGCGACGGTGTCAGTGCAGAACAGCGGAAAC (SEQ ID NO. 254)

TGGTGGCGCCCTAGGCGAGCGAACGCTCACAAACGGCGGTGACCGCTTCTGGTCGTGCACCATCGAGCCGTGCCCAGC

CCGGCCGCGTGCCGTCAGCCGCATCCACTGGATGCCCTTCTCGGCGGTTTCAATCANGTACAGGCGACGTTCGCCACC

ATCGTGCCGGGGCACGGTTAGCGAGAAACGCCGACTTCACCGATTGCCTCGGTGATGxxxxx

Clone Rv23
::::::::::::Rv23T7.seq::::::::::::
AGCTTCGCGGCGTGGCGATCGCGGTTCAAGGCGCGCTCTTCGAGCACAACGAGCGAAGACAGCTCGGCGACGGAGCCT (SEQ ID NO. 255)

TTATCGACATCCGTTCGGGCTGGCTGACCGGCGGCGAAGAACTGCTGGACGCGTTGTTGTCGACGGTGCCGTGGCGAG

CCGAGCGCCGTCAGATGTNCGACCGGGTGGTCGATGTGCCGCGGCTGGTGAGTTTTCACGACCTGACCATCGAAGATC

CGCCGCATCCGCAGCTGGCGCGGATGCGCCGGCGGCTCAACGACATCTACGGCGGCGAACTGGGTGAGCCCTTCACCA

CCGCCGGGCTGTGCTACTACCGCGACGGCTCTGACAGCGTCGCCTGGCATGGCGACACCATTGGTCGCGGCAGCACTG

AGGACACTATGGTGGCGATCGTCAGCCTCGGCGCCACCCGCGTCTTCGCGCTGCGGCCGCGTGG

Clone Rv240
::::::::::::Rv240SP6.seq::::::::::::
AGCTTCAGCTGATACTCGACCAGCCCCACTCGGGCCAATACGTGAATGTCTAGCATCTTCACCCGTTCACGGGCTANT (SEQ ID NO. 256)

CGAGTAGTAGACATTGATTAGCCTGAACGTACCTCCGACGCCAGCTGACGAACGGGTATGACGGATGGATTTCGTGGT

GTCGCGCCCGAGGTCAATTCGTTACGGATGTATCTCGGGGCCGGATCGGGGCCGATGTTGGCGGCCGCGGCGGCCTGG

GACGGACTATCCGACGAACTGGCGGTGGCGGCGTCGTGGTTTGGGTCGGTGACCTCGGGCCTGGCGGATGCGGCGTGG

CGCGGCCCGCGGCGGTTGCGATGGCNCGCGCGGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv240T7.seq::::::::::::
CTGGTCATGGACGTTGCTCCGGTAGTGGCTCACTGCCGATCCTCCTCGTTGAGAGTGCCACCTCAGGGTTGGGTAGGG (SEQ ID NO. 257)

TTGGGTACTCGAAACCAAGTTACCCACCAGTAACACCGTCAAAATATATCCGTTGCATAGGTCAATGCAAGTTGATGT

GAGCTACATTGCACCAACTAACTAACCAACCGGTTGGGTTAGCGGTGATCCTGGCCGTGTCGGTCCTCTCACCTGCGG

TGATAGCGATCAAATGAAGAATATGCGGAGTCTAGGGCGGCAGCGCCTGGCANCGTAGATCATCGGCTCACGCGGATG

CGGCCTCTTGGTACGGACATGCGCGCG

Clone Rv241
::::::::::::Rv241SP6.seq::::::::::::
CTCGTGAGTAGCACCCCTGTAATTTGGGATCGGCAAAAAGGCGAATCACCGCGTGGCCACGACACGCCGGGAGGGACN (SEQ ID NO. 258)

ATCTCGGGCGGCTAGGGCTTCTCGCGGGAAGGCCCGAACGTACGGCGTTTCAACACGTCGCGTCGCCCTCCGACCGCG

AACATTCGGGGATGGCAGCAACCTGG

::::::::::::Rv241T7.seq::::::::::::
GGATCAACTACCGGCCAACGGTGATTCTTGGGCGCCGCTGACGCGCGAACGACCCAGCGACACATTCAGCAGATGGCC (SEQ ID NO. 259)

AGCGCGTGCCGGGCCACGATGTTGGTGCTCGGCGGCTACTCCCATGGTGCGGCNCGTGATCGACATCGTCACCGCCGC

ACCACTGCCGGCCTCGGGTTCACGCAGCCGTTGCCGCCCGCAGCGGACGATCACATC

Clone Rv243
::::::::::::Rv243SP6.seq::::::::::::
AGGACCGTCAGCACGGCGACGTGCTACTCGCCGAGCAGTGGGAATCGCTCTGCAGCAAACCATTACTCTGCGCGACGT (SEQ ID NO. 260)

TCGAGATGACCTTCTGAATGGACGGATCTACCTGCCGCGCGACGACCTGGACCGCGTATGCGTCCGCCTCCGCCTGGA

CGACACCGGGGCACTCTATGACCCCGACGGACGGCTCGCGGTACTGCTGCGGTTCACCGCCGACGCCCGCACGGTACG

CGTCGGGACTGCGCTGAGTCCANCCTCGACGCCGTAGCGCTGCTGCTGTGCGGCCATGTCTGGCATCTACCGCCGTCG

CTCCCTTGA

::::::::::::Rv243T7.seq::::::::::::
CGACTCTGTTGGCCACTGCGGGTCGATCTTGCGGCCGCCCCGGTCGTGGAACGCCCAGGTCACCCCGCGGCGCACCGC (SEQ ID NO. 261)

GGTCAGCGCGTCGTTGGCCAGCGTGGTCACATGGAAGTGGTCGACGACGAGCTTGGCGTTGGGCAGCAGCCCGGGCGT

GCGGATCGCCGAGGCGTATGCAGCGGCGGGGTCGATGGCCACCGTACTGGATGCTCTCCCGGAACTGCGGTGTGCGCG

CTTGCAGCCATGCCAGCACCGCCGCGCCGCCGCGGCCTTCATGCTGCCCATAAACCCTGATACCGGCCAGCTCGACNA

ACCNGTATCCCACGGTCAACCC

Clone Rv244
::::::::::::Rv244SP6.seq::::::::::::
CACACGGACGGCGGTGCGGACGCAGCTGACGCGCATGGTGGTCAGCATCGCGGCCGGTCTGCTGTTGTATGCCTACTT (SEQ ID NO. 262)

CGCGCCGCGCAAATGCTGGTGGGCGGCGGTGGTGGCGCTCGCATGGCTGGGCTGGGTGCTGACCCAACTCTCGAACCA

CACCGGTGGGTGGGCTGGGCTATGGCCTGCCATATCGGCCTGGTGTTCTACN

::::::::::::Rv244T7.seq::::::::::::
CCGATATCCGAGCCGATAGCTGGCGGGCTCGGGTGGTNGCCAGCGGCGCTGCGACGAAAGTGTGACCGTCATGAAACA (SEQ ID NO. 263)

GACACCACCGGCGGCCGTCGGCCGTCGTCACCTGCTCGAGATCTCAGCATCCGCAGCCGGTGTGATCGCGCTTTCGGC

GTGTAGTGGGTCGCCGCCCGAGCCCGGCAAACGCCGGCCCGACACAACCCCGGAACAGGAAGTCCGGTCACCGCGCC

Clone Rv245
::::::::::::Rv245SP6.seq::::::::::::
GCTTCAGGACAAATTGNATCCCTATGCACCCGTTGTCACGCCGATGAGTGAAGACTGCACGCAATCGCCGGAATCCGG (SEQ ID NO. 264)

CAAAACCCTGCACAAGCGAAATCAACCGGAGGCTGACAAGGCAACGTCGGTGATCCGTACCGCCTGGTTGGACAAACG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GCAGAAGGCGCCTCGTCCGGTCCATCTACGCCGAGCACACTGGTGATAGCGCCATCGGCATCGGTGCGGCCACGGTGG

AGACGAACGTCCGCNGGCGTCTGGGTCAGTAACCCGCCGACCAGTTCTCGGGCAAGCTGGTCAACATCGGGCGCCACG

TCTCCAAC

::::::::::::Rv245T7.seq::::::::::::
GTTTGGCGGCCTTATTGCACTGAGGTCGTCAATTGACCCACAGCGGAAATGCCGACTATTCGCAGGCCTCCTTCGCCT (SEQ ID NO. 265)

TGGCTGCCGGAGATGGGCTCCGCGGGAACCGCATGCAGGTATATGACCTCGGTTTCTCGGGTGCTACCGCGTGCCTTG

TCGAGGATGAACTCGGCGTTGGAATTGTCCAGCCGGCCCAATTCATCGAGCGCAGATTCGTACACATGGCCGGCGGCG

ACATACCTTCACCGTGGATCTGCTCCACACGGACCGCCCTCTCGGGATCTGCTCACGGGTAAAGGAATTA

Clone Rv246
::::::::::::Rv246SP6.seq::::::::::::
GCGCACTCCTCCTTATCGCTCCGCTCTGCATCGTCGCGGCGCGGTCAGGTGCAAACGCCTTCGGGGGTGGGGCTCCTG (SEQ ID NO. 266)

CGGAGCACACCGGATACGGAGCGCAACGCGTCGCGTTGTGCGGGCAAACAAGTGTGCAGGNNCCAATGCCATGTCCAG

CAGCTTATCAGTGTCGAACGTGCGAACGTCGCGCCTTCGCCGGTGCCTGAATCTCTACAAG

::::::::::::Rv246T7.seq::::::::::::
CGCTGAAAGCCACCATTCGCGGGTCGGGCGCCGGGCTCGGGCCGCCAGGCTGCTCCGCTCGGTGATGGCACGCCACCG (SEQ ID NO. 267)

CGACACCACCCGGCTGCGCTACGTCGAGCCATACCGGGCGGAGCTACATCGGCTCGGCCGCCTAGTGTTCGGGNCCTC

TTTCGAGGTCGAGGTCGA

Clone Rv247
::::::::::::Rv247SP6.seq::::::::::::
TGTAATTTGGGATGGGCAAAAAGCAAANCACCGCGTGGCCACAAACGCGGGGAGGGACAATCTCGGGCGGCTAGGGCT (SEQ ID NO. 268)

TCTCGCGGGAAGCCCGAAACGTACGGCGTTTCAACACGTCGCGTCGCCTCCGACGCGAAATTCGGG

::::::::::::Rv247T7.seq::::::::::::
CTTGGGCAACATGCTGAGGATCGCCTTTTCACCACGCGGTCGGGGTGGCGTTGCATTAGCTCACCGATGGTGCGCTTG (SEQ ID NO. 269)

TTGCAGGCCGCCGGGATACCCGAGTGCCGGTAAACCATCTTGTGCTGCAGTTTGTCCCCCTGATGGCGACCTTGTCGC

GTTGATCACGATGACGAAGTCACCGCCATCGACATTGGGGGCGAACTCGGCTTGTGCTTG

Clone Rv249
::::::::::::Rv249SP6.seq::::::::::::
GCATGCTTCATTATCTAATCTCCAGCCGTGGTTTAATCAGACGATCGAAAATTCATGCAGACGGTCCCAAATAGAAAG (SEQ ID NO. 270)

ACATTCTCCAGGCACCAGTTGAAGAGGTTGATCAATGGTCTGTTCAAAAACAAGTTCTCATCCGGATTGAACTTTACC

AACTTCATCCGTTTCATGTACAACATTTTTAGAANCATGCTTC

Clone Rv24
::::::::::::Rv24SP6.seq::::::::::::
ATACTCAAGCTTGATGCCGCCGAAACCGAGCGTGAGCACGCCGCCAGCCACCACGCGCGGGTCGGGCGCCGGGCCCGG (SEQ ID NO. 271)

GCCGCCAGGCTGCTCCGCTCGGTGATGGCACGCCACCGCGACACCACCCGGCTCCGCTACGTCTATCCATACCGGGCG

GAGCTACATCGGCTCGGCCGCCCATTGTTCNGGCCCTCTTTCGAGGTCGAGGTCTATACCGATTTGCGCATCCG

::::::::::::Rv24T7.seq::::::::::::
TCCGTACTGGTCGGGTACGCTTCGGTCGCAGTGTGCGAGTGATAGATGACGACCGGGACCTCGTCGGCATCTTCCATA (SEQ ID NO. 272)

GCCCGCCACACCTTCAGTTGCTCACCGGAATCCAACCGGTAGAAGGTCGGCGAGCGCTCGGCATTGGTCATCGGGATA

TGCCGCTCGGGACGGTCAGAACCTCGGGTCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv251
::::::::::::Rv251SP6.seq::::::::::::
GTTCTCGCACGATTTCGGATTAGCGGGATGGTCTCAATTGGGTATGCGGGGAAGGCGCTGACATTCGCCGCGATTAGC (SEQ ID NO. 273)

TGTTTGATGGACCGGGGGTGATTTTTGATCACGGAAATGGGTGTTTATNCAGGTCGCACGCTTTCATCCGGGGCGGAA

CG

::::::::::::Rv251T7.seq::::::::::::
GGGTGTGCCTGCTGTGTATGCACGGCATACGGACATCCTTCCCCTGAAGACCCGCGGTCGAACAGCCACGTGTCCATC (SEQ ID NO. 274)

ATCANGGGGTCAACCCCGGCCAAGGGCGACGGCACGCCAAGTTCGCCGACCGTTAACCTAGTGCTGTTAACTTCATTT

GCTGCGAGCAAAACAGCTGGTCGGNCGTTAGGAATGAATTGAAACTCAACCGATTTGGTGCCGCCGTAGGTGTCCTGG

CTG

Clone Rv252
::::::::::::Rv252T7.seq::::::::::::
ACTACCCGGCCAACGGTGATNTCTTGGCCGCCGCTGACNGCGCGAACGACGCCAGCGACCACATTCAGCAGATGGCCA (SEQ ID NO. 275)

GCGCGTGCCGGGCCACGANGTTGGTGCTCGGCGGCTACTCCCANGGTGCGGNCGTGATCGACATCNTCACCGCCGCAC

CACTGCCCGGCCTCGGGTTCACCAGCCGTTGCCGCCCGCAGCGGACGATCACATCGCTTTTATTTNNTNTTCNGGAAT

CCCTCGGGCCGCGCTGGCGGGCTGATGA

Clone Rv253
::::::::::::Rv253SP6.seq::::::::::::
ACGTCGGGANACTGTTCGCGTTCATCCTCGTCTCGGCGGATTGGTCTGCTGCGCCGGACCGACCGATCTTCAGCGGGG (SEQ ID NO. 276)

GGTCACGCTCCGTGGGGTGCCGTTACTTCCGATCGCCCAGTGTGCGCGTGCTGTGGCTGATGCTGAACCTCACCGCGT

TGANTTGGATCGGTTCGGGATCTGGCTGGTGGCCGGAACGCNATTTATGTCGCTACGGGCGCCGGC

::::::::::::Rv253T7.seq::::::::::::
GCTCAAAGGCACTACTGGCACCAAGGCCCACACGTCACCTGTGACTCCTGCGCCGACCCGCCCGAGGTCTGGCCGTTA (SEQ ID NO. 277)

CACCGAACGGGCGAGCCGGGAGTTGGTACCATCGAACAAGACAAGGTGCATGGGCGGAGTTGTTCCGCCACTTCGTCG

ATGACGGGTC

Clone Rv254
::::::::::::Rv254SP6.seq::::::::::::
CGATACCGGCTGCTTACCGAGACATCCACCATGCCACCCGAATCACCGCACGCGCCGAAATCGCACAACAGCTTGACG (SEQ ID NO. 278)

CCTTGCAGGTTCCGCGATTGGAATTGCCGACGGTCTCTGACGGCGTCGACCTTGGCAGCCTCTACGAGCTCTCGGAAT

CACTTGCCCAGCAGGGGGTTCGATGAGTGTCACACCGAAGACCTCGATATGGGCGCAATCCTGGCCGACACATCCAAC

CGGGTGGTTGTGTGCTGCGGCGCCGGTGGGGTCNGCAANACACTACCGCGGCCGCGCTGGCGTTGCGCGCGGCCGAAT

ATGGCCGCACTGTGGTCG

::::::::::::Rv254T7.seq::::::::::::
CGTCGTCGTCGTGGTATGCGATAGCCATCCCGTCGGGCTACTCGCCATCACCGATCAGCTTCGCCCCGAAGCCGCCGC (SEQ ID NO. 279)

GGCGATTTCCGCTGCGACCAAACTGACCGGGGCCAAACCGGTATTGCTTACCGGCGACAACCGGGCCACCGCCGATCG

GCTCGGTGTACANGTTGGCATCGACGACGTACGGGCCGGGCTACTGCCGACGACAANGTCGCAGCCGTGCNGCNGCTG

CAAGCTGGAGGTGCCAGATTGACCGTGGTCGGTGACGGTATCAACGACCTCCGGCCTTAGCGGCCGCGCATGTCGCAT

CGCCATGGGCAGCGCCCGAC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv255
::::::::::::Rv255SP6.seq::::::::::::
GCACGCAATCGAAGTCACCCAAACCGGGCGGGCCAGGCGTCTNACGCCACGTCNACCAGCCGCAACCTCAACCCGGCC (SEQ ID NO. 280)

ACGGCGAGCTCCTGATCAAGGCCGAGGCCATCGGTGTCTACTTCATCGACACCTACTTCCGCTCCGGGCAATATCCGC

GCGAACTCCCGTTCGTCATCTGCTCCGAAGTATGCGGCACGGTGGANGCCGTCGGCCAGGGGTTAC

::::::::::::Rv255T7.seq::::::::::::
TCGACTGTGTGGCCACAGATCACGCCCCGCATGCCGAGCACGAGAAATGCGTCGAATTCGCCGCGGGCCGGCCGGCAT (SEQ ID NO. 281)

GCTCGGGTTGCAGACGGGATTGTCGGTGGTGGTGCATACAATGGTGGCGCCGGCTTGTTGANTTNGGCGCGATATCGC

GCGGGTGATGAGTGANAACCGGCGTGCA

Clone Rv257
::::::::::::Rv257SP6.seq::::::::::::
GAACCTGACACCCTGGTCACGGGTGAGCACGGACTTGATTTCTTCNCTATTGGTCGGCGCTGTTGAGCACACCACGCC (SEQ ID NO. 282)

GCTGACGGCCGTCGCGTCCTCGCTGTGCTCGGTCTGGTGGAGCGCGCTGCCCGCGGCCNAACATCNTAAATCAAGCGT

ATTCGTCAACAGATATCATCAATGTCGGCGCTGGACTATTCAAATCATCGATATACTGGTGACCTGGTCCTTCGCCAT

CGATCAATGGCGATAGTCACGCAAATCGTCACGGACATCGTCGGCGTCCCAGCTGGCCCGTGCCAACAGATGCTGCAA

CCCATCGGGGTGGTATCACCGCGGTGCTCGGCGATGGTCCACAATTCTTGCGGTCCAAGCCCNAAACATCCCGGGCAT

GAATTCACCGGCATGCGCN

::::::::::::Rv257T7.seq::::::::::::
CTATCGTACCGCGCCGGTCACCTTCTGGATATCGCCGGCCTGGTCAAGGGGGGCGTCCGAGGGAGCCGGGCTGGGTNA (SEQ ID NO. 283)

CAAGTTCCTGGCTCATATCCGCGAATGCGACGCCATTTGTCAGGTGGTGCGGGTGTTCGTCGACGACGACGTGACTCA

TGTCACCGGACGGGTCGATCCCCAGTCCGACATTGAGGTCGTCGAGACCGAGCTGATCCTGGCAGATCTGCAAACCCT

GGAGCGGGCCACGGGCCGGCTGGAGAATGAAGCGCGCACCAACAAGGCGCGCAAGCCGGTCTACGAAGCGGCACTGCG

TGCCCAGCANGTGCTCGACGCCGGGCAAGACGCTGTTCGCCGCGGGGGTGGATGCCGCCGCGTTGCGCGACTGAAACT

GCTGACCACCAAGCCCTTCCTGT

Clone Rv258
::::::::::::Rv258SP6.seq::::::::::::
TACTCAAGCTTCAGGCCGCCACGTCCGCCGTCCGTCGGCGACGTGACCTCGAGCGCCGAGTTCGACTCGACATCGCCG (SEQ ID NO. 284)

CCGGCGCATGCCGACATGAACGCGGCACTCACCGCAAGCCCGTCGGACGTCAGGTCGATCGACTCCGCTTCAAGCACC

GGATCGTCCGGGCAACTCGCGGCCTCGGCCTGTGCGAACGGCACACCCGTCGTGGCGGCNCCCCGCGCGGAACTGGGC

TCATCACGGTCGTTGCGAGCCGGTCGCGTCACCGCGTACCGACGCCGTC

::::::::::::Rv258T7.seq::::::::::::
CCGACATCGAGTGGGCTCGCAGTGACTTGGCGACCTCCAAGCCACCGGTACCCGCCGCGCGGCAAGCCAAGGACGACG (SEQ ID NO. 285)

ACGGCCTTGCCGGATAGCTGCGCCAGGCGTTGCGCCAACTGGCGTCCAGCGTCGCCACGATCGTCAAAGAGCTTCATC

TGCCGAGTGTGTCGCCATCTCATGGCTCCAAATATGGAATTAGGTCCCTGGGCCGACTGACGACAGTCCCTCAGCGAC

CGGATTGCGCATCCCGCCTTGTACGCTACTCCGCAAATCCCGGGCTTGCGTCCGCGGAAGCGAACTCGGCGGCGCTAC

GTGGTGGTTCACTTCGGCCGTGCGCACTCGGATCGACGGGCCGATGGTGGCCGGGCCCGCGCGCTTCTTGGTCATCCG

ATTGAGT

Clone Rv259
::::::::::::Rv259SP6.seq::::::::::::
ATACTCAAGCTTGTCGCGGTAAACCGCACGCAGGGCGGTGGGTGCGGTGTCAAAGACACCCACACTTCTTTGCGGTTC (SEQ ID NO. 286)

GGTGATCTCGACACCGGCCGCGAGCCGACCACCATGCGCGCGTAGATCGGCGATCAGCGCGTCGGCTATCGCCTGGGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GCCGCCCACCGGAATCGGCCAGCCGACCGAATGGGCCAGCGTTGCCAGCATCAGTCCGGCGCCGGCCGACACCAGTGA

CGGCAACGGTGAAATCGCGTGGGCGGCAACGCCGGTGAACAACGCGCGGGCATCCTCGCCCGCCAACGACCGCCAGGC

AGGGTGCCTGGGCCATCATCCGCAGCCCGA

::::::::::::Rv259T7.seq::::::::::::
TGGACTCATAACGATCGGGTCAGCGACGCGCCAACACGAACGGCCGGACGAGTGGGCCAGGGTCGCGCCTCCCCTACA (SEQ ID NO. 287)

AACAGGATCCGTTGCCTGCGAGCGACAGGCTCCGGTGCGGCGTTGGGCGCCGTGCTCGTCCCAGCGTCCGGTCCCGGG

TCGCCGGCGACGCTTGTTTCCTCCATACTCGCCCCCTAATCTCGAGGCAGCCCGTACCCGCAGGCAACCTCCCAAAAA

TGCAATCCCCCAAAATGCAATGCGTCGAGCTATTTCTCACACCGACCGCTAGTTGCGGATCAGAAATCCGTTGGGCGC

GGAAGTCCAGCCGAATTTGTTCTCCCGCTCCGCATCATGCTTGTAATCGTTTGGAAATCATCCTCATATGCCTCGATC

GCTTCATAGGTCAAGCCCAAACCCGGCAGGATGGGTGGCC

Clone Rv25
::::::::::::Rv25SP6.seq::::::::::::
CTTTACACTTTATGCTTCCGGCTCGTATGTTGTGTGGAATTGTGAGCGGATAACAATTTCACACAGGAAACAGCTATG (SEQ ID NO. 288)

ACCATGATTACGCCAAGCTATTTAGGTGACACTATAGAATACTCAAGCTTAGTGGTTGCGCACGTAAATTCGTCAGGT

GACCGATCCCCTGCTGTCTCACTCGCCTCACAGCGACCACCACGGCTGGCGCTCAAGGCGGGCACGTGCGGAGCAGAT

GAGGAATGTGCGACGTCTTGATGCAGCCTGTCAGAACACCGAGACCCTCGACGAACTTACGATCGAAACCGCTTAGGC

CAACCGGTGACGGGGGTGTCTTTCCGCGGCTAGGGCGCCTTATCGTCCGAAGGCCGTGGGTGGTGATCGCCTTCTGGG

TCGCGCTTGCGGGTCTGCTTGCGCCGACGGTGCCGTCCCTGGACCGATCTCCCAGCGGCATCCAGTGGCGATTCTGCC

ATCGG

::::::::::::Rv25T7.seq::::::::::::
CAGGCATGCAAGCTTGCGATGTATCAACACGCCGTTGCGCAGCGTGAGCCGATAGTTGACATCCGGCTCGGTGAAGGT (SEQ ID NO. 289)

GAAATCGATGGCCAGGTCGAGGTCCCATGCGCGTGGGCCATTGATGCTGATCGCCAGGACGTCAAAGATTTGGTCCGG

CGTCAGCTGGGCGAAAAACGTGGGCGCCGGGACTTGCCCGGAGCTGCCCGGGTTCCCGTCGCGCAGCTCGGCGGCCCC

GGTCAGAAAGAAATTGCGCCAGGTCGCACACTCCGCGCCGTAGGCCAGCTGCTCCACGGTGTCGGCATATAGCCCGCG

GGCCGCAGCGTGCTCGCTGTCGGCGAACACCGCATGGTCGAGAAGCGTTGCCGCCCAACGGAAATCACTGCGTCAAAG

CTTCGCCGGGCCACTCCAGCACTCCGTC

Clone Rv260
::::::::::::Rv260SP6.seq::::::::::::
ATACTCAAGCTTGACCGACGCTGATCGCACCGCACGCGGGAACCTCAAGGGCACTACTGGCACAAGGGCCCACACGTC (SEQ ID NO. 290)

AACCTGTTAACTCCTGCGCCGACCCCGGCCGAAGTCCTTGGCGTTAACACCGAACGGGCCAACCCGGGAATTTGGGTT

CCATCAAAACAAATAGCAGGTGCCTGGGCGGAGTGTTC

::::::::::::Rv260T7.seq::::::::::::
GTCGTCGTGTGCTGGGGCGTCCGTATCAGCACGCCCACGAAATGGGGCACAAGAAGGATTCCTGGAACGGTGGCTGTC (SEQ ID NO. 291)

CAAGATCACCCTCGCCCAAAACTGCTACGGGCACTTCTACATCGAGCACAACCGTGGCCATCACGTCCGCGGTGTCCA

CACCGGGAGG

Clone Rv261
::::::::::::Rv261SP6w.seq::::::::::::
ATATGCCTTGCTGAGCTTTTCGGATCGCAGCGAGTCGTACCCGCGCCGGTCACCTTCGTGGATATCGCCGGCCTGGTC (SEQ ID NO. 292)

AAGGGGGCGTCCGAGGGAGCCGGGCTGGGTAACAAGTTCCTGGCTCATATCCGCGAATGCGACGCCATTTGTCAGGTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GTGCGGGTGTTCGTCGACAACGACGTGACTCATGTCACCGGACGGGTCGATCCCCAGTCCGACATTGAGGTCGTCGAG

ACCGAGCTGATCCTGGCAGATCTGCAAGCCCTGGAGCGGGCCACGGGGCGGCTNGAA

::::::::::::Rv261T7.seq::::::::::::
GACACCCTGGTCACGGGTGAGCAGGACTCGATTTCTTCGCTATTGGTCGGCGCTGTTGAGGCACAGCACGCCGCTGAG (SEQ ID NO. 293)

GCCGTCGCGTCCTCGCTGTGCTCGGTCTGGTGGAGCGCGCTGCCCGCGGCCGAACATCGTAAATCAAGCGTATTCGTC

AACAGATATCATCAATGTCGGCGCTGGACTATTCAAATCATCGATATACTGGTGACCTGGTCCTTCGCCATCGATCAA

TGGCGATAGTCACGCAGATCGTCACGGACATCGTCTGCGTCCCAGCTGGCCCGTGCCAACAGATGCTGCAACCCATCG

GGGTGGTATCNCCGCGGTGCTCGGCGATGGTCCAACAATTCTTGCGGTCCAAGCCCGAAACCATCCGGCCATGAGTTC

ACCGGCATGGCGCAACGGCTGGTGCCGGGCAAAACGCGGCGCGATCGAATTC

Clone Rv262
::::::::::::Rv262SP6.seq::::::::::::
TGTAGAAGGTGGGTCCCGTCCAACTTCGCGGCGGCGGCGCGATATGCCTTGCTGGTCTTGCTCATTTGATATCCAATC (SEQ ID NO. 294)

TATGGGTCGTGGTTACTCAACGGGCCGAAGCTGGCCCTCCCACGGGTAGGGTCCTATTCGACGGTGATGTCC

::::::::::::Rv262T7.seq::::::::::::
CCCGAATCCGGTGGCCGGCAGGGGGCCTGGCGACGTGGACACCTTCTAACTTGTCTTTACCGGTCACTGTTGCACCCC (SEQ ID NO. 295)

AACACCTTTAACGACGTGGACGGACGTTACATCGGATTCGACGGTGTCATCCACAGCGTTGCCATTGGGCACACCCAC

TACGCCAATTTCTCCGACTGGGACACCTACCGCAGCCTCGCCCCACTGCAGGGACTGTTGTTCCCGCAACGGGCCATC

GACATGATCCAGTCGTTGGTGACCGACGCGGAGCAGACTGGTGCGTATCCGCGTTGGGCGCTGGCGAAATTCCGCCAC

CGGCATGAT

Clone Rv263
::::::::::::Rv263SP6.seq::::::::::::
TTGAGATGCTGGTCGGGATGCCGATGGTTGGAACATGGTCCCCTGGCCTCGAATACGCGCGAGCGCATGAGCTCACCG (SEQ ID NO. 296)

GTTCGGAACAACGTATCGAAGAACTCGCACTGCTGGCAGATGGTATCTCCGATGTGGTTGTAATTTGTATCCCAACTC

TAACTGTGCTATCGGATCTGCGTGAATA

::::::::::::Rv263T7.seq::::::::::::
CGTAATCACGATCCCGCTGAGACACTTGACCTTACGGCCGAAGTGACTTCGCTGCTGCTATGCCGACACCCGATTTCC (SEQ ID NO. 297)

ATACGCTGCTGTACACGACGGCCGGGCCGGTGGCCTCCATCACGCTCAACCGCCCGGAACAGCTCAACACCATCGTCC

CGCCCATGCCCGACGAGATCGAGGCCGCTATCGGGTTGGTCGAACGCGACCAGGACATCAAGGTCATCNTNCTGCGCG

GTGGCGGGCGCGCCTTCTCCGGCGG

Clone Rv264
::::::::::::Rv264SP6.seq::::::::::::
CAAGCTTAAGCTGGTTCCGGCCACTCCATGAGCCGTAGTGCAATGGTTCGTGCACGGCGAGGCCGAACTTGCCATAAA (SEQ ID NO. 298)

CATCCCTGACGAAAGTCTCCGGCAAGCCGATTGCTTCTTCGGGCCGCTTCTTGTGGATTGTCCGATAACCCGGTCCCT

CATGCTGGAAGTTGTGCGCACTCTTTCCTTCCGCGATGTGGGCTAACGACTCGTCATTGAGCAAGAAGTACGTGCACA

GGCATCGTCCGCCGGGCTTCAGCACGCGGGAGATCTCGTCCAGATAGTGCTCCACGTCCGGNGGGAAACATGTGGGTG

AACACCGAGGTNAGAAACACCNCATCCAACGACGCATCCGGGATATGGAAAGCGAAA

::::::::::::Rv264T7.seq::::::::::::
TATGGTCTTCGTCGACCAGTACGTCGTAGGCGCCATGAGCCAGCGACTGAAGCCGCGCCATGCCTGCACGGCCCGCTC (SEQ ID NO. 299)

ATCCAGCGAGGCGGCCATCTCCCGCAGATAGCCTGCCGCCTCGGCGCGCACGCTGTCCGGATCGCGTCCGAGCTCGTC

GGCCAGCGCACGCAGCCGCTCGTCATACCATCGGGCATCCAGCAGTTGGGTAACCTCAACGGGGTCGGTCGCTAGCGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGTCATTGATTCAGCAACAATACCGATGCGCTGCAGCAACTTTCGCAGTCCGATGCGGCCCACCTCCCGTGCAGTCAC

TGGCTAGCCCCCGTCATGCCGGTTGTGTCGATGGCACGGCAGCGGGCTCGTAAACCTGCGGTCTCAGCTCGCTGG

Clone Rv265
::::::::::::Rv265SP6.seq::::::::::::
GCTTAGCGGTCTTGCTCGAACCGACATTGCGTGCCACTCATGAGCGGGTGGCGGTCGCGGTGCTTACACATCT (SEQ ID NO. 300)

::::::::::::Rv265T7.seq::::::::::::
GTATCTGGCGCCTCTCGAATATCCTTGAACGTCCCGCGGTGCCACCCAGATAGATCGCAGCGCCCTGCAATGGAGTTC (SEQ ID NO. 301)

CCTTTATGGCCTCTCTAGCCTCCCGCTTGATCGGCTCGACCCGAGAGATGCCCTCGGGCGTTGCGGGATCTCCCTCCA

Clone Rv266
::::::::::::Rv266SP6.seq::::::::::::
CTTCACGCCGATCCGCGACCGCGAACGCGACGGTGACGGTGGGCGACAAGGTTCGGTTGGTCGCCGCGGCGCTGGGCG (SEQ ID NO. 302)

ATATCAGCTCACCCGGTTTCGAGGTGTTCGGCGACCGGACGGTGCTGCAGACATTCTTGAGCGTCCTCGACCGGCCCG

ATTCGGCCTTCAACATCGTGACGCCGTATTTCGGCGGTACCGCTCGGCGCCGAGTCGAAGGCGGCCTGAGCTAAAGCC

GGGCATTGGGCGAGTGGTAAACAAGTTCGGTGACTTCGGTTGACCGACTCGACGGGCTCGATCTGGGCGCCCTGGACC

GGTATCTGCGTTCGCTGGGGATCGGGCCNACCGCNANTTGCGTTGCGANCTGATTCCGGTGGAGCTCCAATCTGACTT

CCGG

::::::::::::Rv266T7.seq::::::::::::
GCAGCTACCGACCCTAGCGACGAGTGTGTTCGCAGCGTCGAATGTGAACGTTCGGCGTGATTCGGCGCGCGGGTTCCC (SEQ ID NO. 303)

GCTCTCAGCGCACGTTCGGCGCCGAGGNGGCTAGTCCCTGGTTAAGCAATGTCTCGGTCGCCGCCAGCAGCGCGCATG

TCGCCAACCCGTCNACCGCGTTGCGCATGTCCGGTACCGACGGAAACGACGGCGCGATCCGGATGTTCTTGTCGTCCG

GATCCTTTCGATACGGGAACGACCCCCCGCCTCGGTCACCGCGATACCAACGTCCTTACCCAANGCTACNGTCCGGCG

CGCGGTCCCGGGCAACACGTCGAAGCTGATGAANTAACCACCCTTGGGCTCGGTCCAAGANGCGATCTTGGACTCCTT

AACCGCTGATNCAA

Clone Rv267
::::::::::::Rv267IS1081N60.seq::::::::::::
TCCCCATCGGCGCCGGACCGTTTGAAAGTCCAAGCACGGGTGGGATGGAATCGACGACAGTTGAGCGCCGTCGGTGGC (SEQ ID NO. 304)

CGTGGTCAGCAGCTGTTCGCGAACGCACCAGGTCACATCCCTTCGACATCTCACCGACGTGGCACGGGCGACATCAAC

AGGAAGATTGACGAATCCCTCGCAGGCGCGGCACGTCCGCAGGCCAACGCCAACTACGGGGCCACCAGCGATCCTCCG

CTCACGCACCAGCCCAAGCCAGGCTCANCCACCCAAGTCGGCCCGCGCTCTCCCTCGCCCCCTGGTCTCCGGGGCCTT

GTTAAACAACTACCGGAAGTCCACCAATCCTCGCTGCATCTCGACACCGTCCGCCTCACTCCCTTCCTCCCGCCCCTC

TCCACACNACACACCTCTTGCATTAAGGTCACGGAGCGGTCACTTTTCGTCGGACGAAATTCGCAATCCGGCCGCTCG

CCGCCAGAGAT

::::::::::::Rv267SP6.seq::::::::::::
CGGAAAGTGGATACTCCCAGCAGGTAGCAGGTCGCCACCACGCTGGTCAGTGCGCGTTCAGCTCGCTTGCGGCGCTGC (SEQ ID NO. 305)

AGCAGCCAGTCCGGGAAATAGCTGCCCTGGCGCAGCTTGGGGATCGCGACGTCGATGGTTGCGGCACGGGTGTCGCAA

ATCACGGTGGCGGTAGCCGTTGCGCTGATTGGACCGCTCATCGCTGCGTTCGCGGTAGCCCGCCCCGCACAGGGCGTC

GGCTTCAGCCCCCATCAAGGCGGCGA

::::::::::::Rv267T7.seq::::::::::::
GGCCGAGTCCAGCACTTCGCACTATGTGCAGACCAAANACCCGGTGGTCGCCGCGCTGCGGCAGCGGCTGGCAACGGC (SEQ ID NO. 306)

GCCGGTGATCACCGAGTGGTGCGNAGTTGCCGACCGGCAGTTCGCCGCGGGCTTACTACGAGAAGGGCCTGCGCGACG

TCATCAGGTATCACGTGTCGATGACGTCGAGCGTTAACTTCCCCGACCAGACGGCGACCTCGCCGATGGACCCCGCGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TGTACCTGGTGTGGGCGCAAGCTAACGCCGCCGCANGCTATCGGTACTCGGTCGAAGCGCAGCCGGGGTCGCAAGCGC

TAGCGGGCAAGGTCGCGACGATCTCGGTCACCTGGACCAACTACGGCGCTGCTGCCGCCACCGAATAGTGNGTGCCCG

GCTACCGGCTGGTGGATTCCACGGGACATGTGGTTCGGACCTGCCGGCAGCGGTGGAACTGAAGANGCTGGTCT

Clone Rv268
::::::::::::Rv268SP6.seq::::::::::::
AGCTTCAAGGACATCGTCATCGCGACCAAAACCGCGAGCTAGGTCGGCATCCGGGAAGCATCGCGACACCGTGGCGCC (SEQ ID NO. 307)

GAGCGCCGCTGCCGGCAGGCCGATTAGGCGGGCAGATTAGCCCGCCGCGGCTCCCGGCTCCGATTACGGCGCCCCGAA

TGGCGTCACCGGCTGGTAACCACGCTTGCGCGCCTGGGCGGCGGCCTGCCGGATCAGGTGGTATATGCCGACAAAGCC

TGCGTGATCGGTCATCACCAACGGTGACAGCAGCCGGTTGTGCACCATCGCNAACGCCACCCCGGTCTCCGGGTCTGT

CAN

::::::::::::Rv268T7.seq::::::::::::
GCTCGCGGTCCAGCAGCAGACGTGTCTGACCCCGACGCCCGGCCGCCGGTACCGAAACCGGATCGGCCCGCCGATGGC (SEQ ID NO. 308)

CGCGGCCACGGCGTCTGCCTTACCCGGCCCGGATACCAGCAGCCACACCTCGCGGGAACGCTGAATCGCCGGCAGGGT

CAAGGTGATTCGGCGTGGCGGCGGTTTCGCGAATCGTCCACCGCCACCACCATGCGGGTGCTCTCGAAGACGCGGGGC

TGTGCGGGAACAGCGAGTTAATGTGGCCCTCGGGCCCCATGCCCAGCAGGTGGACGTCGAAATTCGGCCCGGGTCACC

TGGTGCGGCACTGGCGGCC

Clone Rv269
::::::::::::Rv269SP6.seq::::::::::::
AGCTTGTCGATCGTCCGGCAGCGTCCGGCGAGTCAAGTCGAAGCCAGTCCGGTCTCCTCTCCGACTACGGCCAAGAAC (SEQ ID NO. 309)

TGGGCGACGGTGTCAGTGCATACCAGCGGANACTGGTGGCGCCCTAGGCGAGCGACCGCCTCACAAACGGCGGTGACC

GCGTTCTGGTCGTGCACCATCGAGCCGTGCCCATCCCGGCCGCGTGCCGTCAGCCGCATCCACTGGATGCCCTTCTCG

GCGGTTTCAATCAGGTACAGGCGACGTTCGCCANCATCGTGCCGGGGCANGG

::::::::::::Rv269T7.seq::::::::::::
TTGGTGATCATCGNCCCAACGACCCCGAGGCGATGTTCTTGCACACCGAGGAGTGTCGCAAGCTGGGGCTGGCCTTCG (SEQ ID NO. 310)

CCGCCGATCCGTCTCAGCAGCTGGCGAAGCTGTCGGGGTGAGGAAATTCGCAGGCTCGTCAACGGTGCTGCTTACTTG

TTCACCAACGACTACTAATGGGATCTGCTGCTGTCCAAGACCGGCTGGTCAGANGCCGATGTGATGGCGCAGATCGAC

CTGCGGGTGACCACATTGGGTCCTAAGGGTGTCCATTTGGTAGAACCTGACGCACCACCATCCACGTCGGCGTTGGTC

CCCGAAACAGCCAGACCGA

Clone Rv26
::::::::::::Rv26SP6.seq::::::::::::
GGCTCGTATGTTGTGTGGAATTGTGAGCGGATAACAATTTCACACAGGAAACAGCTATGACCATGATTACGCCAAGCT (SEQ ID NO. 311)

ATTTAGGTGACACTATAGAATACTCAAGCTTGATTTTGATCATCATGATGATCATCACCCGAAGTGTGGTAGCCGCAG

TGGTTATCGTGGGTACCGTCGTGCTTTCCATGGGCGCCTCTTTCGGGCTTTCCGTATTGGTCTGGCAGGACATTCTGG

GTATCGAGTTGTACTGGATGGTGTTGGCGATGTCGGTGATCCTGCTCCTGGCGGTGGGATCCGACTACAATCTGCTGC

TGATTTCCCGGTTGAAAGAGGAAATTGGGGCCGGATTGAACACCGGAATTATCCGTGCCATGGCTGGTACCGGGGGAG

TGGTGACGGCTGCCGGCATGGTGTTCGCCGTTACCATGTCGTTGTTTGTGTTCAGCGATTTGCGAATT

::::::::::::Rv26T7.seq::::::::::::
CAGGCATGCAAGCTTGGCGTGCCGTTCCAACCCGAATTGGCTTTCGGCGCCATCGGTGAGGACGGCGTGCGGGTGCTC (SEQ ID NO. 312)

AACGACGACGTCGTCCGCGGGACACACCTCGATGCTGCCGCCATGGACGCGGTCGAACGCAAGCAGCTGATCGAGCTA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAACGCCGCGCGGAACGCTTCCGCCGCGGGCGTGACCGCATCCCGTTGACCGGGCGGATCGCGGTGATCGTCGATGAC

GGCATCGCCACCGGAGCGACGGCCAAGGCGGCGTGCCAGGTCNCCCGGGCGCACG

Clone Rv270
::::::::::::Rv270SP6.seq::::::::::::
GGCATCTTGGCCGCCATGTTAGCCACACTGCCACCGGCTATAGAAGCGATGCGCACCGTCCTGCCAGCACATTGCGGC (SEQ ID NO. 313)

GCTCCTCCCTGGAAAGCAAGATAACCAAGCTCATGCCGTGGTTGTGGGTGGCGTGGTTTGGTTTGGGTAACTTTGG

::::::::::::Rv270T7.seq::::::::::::
TCGGCTAATAATCGTCGACGCCGGCCTCCTCTGCAATCGCCTTGGCGGTCGCCGGGTTGTCACCGGTGATCATCACGG (SEQ ID NO. 314)

TGCGGATGCTCATTCGGCGCATTTCGTCGAATCGTTCCCGTATGCCCACCTTGACGATGTCCTTCAGATGGACGACGC

CGATGGCCCGCGCGCTGCTGTTATCGGTCCATTCCGCAACGACTAGGGGTGTCCCCCGCCGGAGCTGATGCCGTCGAC

AATGGCACCCACCTCCTCGGTGGGGTGGGCACCGTGATCGCGAACCCACTTCATCACCGCAGCCGCGGCACCTTGCGG

ATTCGACGGATG

Clone Rv271
::::::::::::Rv271SP6.seq::::::::::::
CTCAAGCTTGGAGGCGTGGCGATCGCGGTCCAAGGCGCGCTCTCCGAGCACAACGAGCGAAGACNGCTCGGCGACGGA (SEQ ID NO. 315)

GCCTTTATCGACNTCCGTTCGGGCTGGCTGACGGCGGCNAAATAATGCTGGACTCGTTGTTGTCGACGGTGCCGTGGC

GAGCCGAGCGCCGTCAGATGTACGACCGGGTGGTCTATGTGCCGCGGTTGGTGAGTTTCCACGACCTGACCATCGAAG

ATCCGCCGCATCCGCTGCTGGCGCGGATGCGCCGGTGGCTCAACTAATTCTACGGCGGCGAACTGGGTNATCCCTTCN

CCACCGTCGG

::::::::::::Rv271T7.seq::::::::::::
CCTAGGTCAACCGTACCGTCATCGGATCGGGGTCGACCGCACAGATGGACTGGAGCTTCGGCGAGGTCATCGCCTATG (SEQ ID NO. 316)

CCTCGCGGGGGGTGACGCTGACCCCGGGTGACGTGTTCGGCTCGGGCACGGTGCCCACCTGCACGCTCGTCGAAGCAC

CTCAGGCCACCGGAAATCATTCCCGGGCTGGCTGCACGACTGCGACGTGGTCACCCTCCAGGTCGAAGGGCTGGGCGA

GACGATGCAGACCGTCCGGACGAGCGGCACTCCTTTTCCGTTGGCTCTTCGGCCGAATCCGGACGCCGAACCCGACCG

GCGCGGGGTCAACCCGGCACCGACGCGGGTGCCGTTTACCCGCGGGCTGCACAAATCCCGACGGGTATGGGCTTTGAC

CTGCCGACGGGGGA

Clone Rv272
::::::::::::Rv272SP6.seq::::::::::::
AGCTTGGCGTGACACCAACACAGGGCACTTAAGATGGCAATGCGCCGCCTACCTGCACGTTTTCGCGATGTCAGAGGA (SEQ ID NO. 317)

TGCCGAGGGGAGAACAATGCGAGCACGGCCGCTGACGTTGCTCACCGCTTTGGCGGCGGTGACATTGGTGGTGGTTGC

GGGCTGCGAGGCCCGAGTCTAGGCCGAAGCATATAGCGCGGCCGACCGCATTTCGTCTCGACCGCAAGCGCGACCTCA

GCCGCAGCCGGTGGAGCTACTGCTGCGCGCCATCACGCCGCCTAGGGCTCCGGCGGCGTCGCCGAACGTCGGGTTTGG

CGAACTGCCTACCCGGGTCCGGCAGGCAACCGAT

::::::::::::Rv272T7.seq::::::::::::
TCATGCCGTTGGACCGACCATCGGAGTTAGTTGCCGAACCGCGGGACCACCGCAAGCACCCGGTCCTGGTCGCGCACC (SEQ ID NO. 318)

GCGTCGGCCAACCGCTTGAGCACCACCACGCCGCAGCCCTCGCCGCGCACGAATCCATCCGCGTTGGCGTCGAAGCTG

TTGCATCGGCCGGTCGGTGACAGCGCCGACCACTTGGACAGCGCGATGGCGGTGAACGGTGACAAGGTGAGCTGCACC

CCGCCCGCCAATGCGACGTCGGTTTCACGCAGGCGAAGCTCTGACACGCGAAGTGAATTGCCACCAGCGACGACGAAC

AAGCGGTATCTACGGCGATGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv273
::::::::::::Rv273SP6.seq::::::::::::
GGGTCGACTTTCTGCAAGGCGAGGCTACACCGTCGTCGTCGTGGTATGCGATAGCCATCCCGTCGGGCTACTCGCCAT (SEQ ID NO. 319)

CACCGATCAGCTTCGCCCCGAAGCCGCCGTGGTGATTTCCGCTGCGACCAAACTGAACGGGGCCAAACCGGTATTGCT

TACCGGCGACAACCGGGCCACCGCCGATCGGCTCGGTGTTCAGGTTGGCAT

::::::::::::Rv273T7.seq::::::::::::
AATCCGAAATCCTGACCGATACTTGAACCTGGTCTCGTTCGGCAATAACTCGTCGGCGTGCAGGACCCGGCGCAAACG (SEQ ID NO. 320)

TACTTCGGCATCAACGCGTCCGACCTGAATTGGCAGCAAGCGGCGCTGCTGGCCGGCATGGTGCAATCTAACAGCACG

CTCTTCCCGTACACCAACCCCGACGGCGCGCTGGCCCGGGCGGAACGTGGTCCTCGACACCATGATCGAAAAACCTTC

CCGGGGAGGCGGATGC

Clone Rv274
::::::::::::Rv274SP6.seq::::::::::::
TTCCGAATTTCGGGTCCNGGTCATATGACCCTCATGGAAGAAGAAGCGGCCGCCCCGCGCCCGTGCGACGGCGAATGA (SEQ ID NO. 321)

AAACCCTCACCCAGGCCGCATTGAACGCCGACAAGACGGTGGAGCAGGTCGAAGACGTCCTGGACGGTCTGGGTAAGA

CCATGGCCGAGCTGAACAGCTCGCTGTCACAGCTGAACAGCACCGTGGAGCGCTTGGAGGACGGTCTGGACCATCTCG

AAGGTACCCTGCACAGCCTGGACGATCTCGCGAAACGGCTCATCGTGTTGGTCGAGCCGGTGGAAGCCATCGTCGATC

GGATCGACTACATCGTGAGCCTCGGCGAAACGGTGATGTCACCGCTGTCGGTC

::::::::::::Rv274T7.seq::::::::::::
NCTCGATCTTGGGGTACGTTCGATGAGGCTGCTGACCAACAACCCGGCCAAGCGGGTGGGACTGGATGGATACGGATT (SEQ ID NO. 322)

GCACATCATCGAGCGCGTGCCGCTGCCGGTGCGGGCCAACGCGGAGAAACATCCGTTACCTGATGACCAAGCGTGACA

AATTGGGGCACGACTTGGCTGGGTTGGACGATTTTCACGAATCCGTGCATCTGCCCGGAGAATTCGGCGGTGCCTTGT

GAAGGTGGCGCCGGGGTGCCGGATCTGCCGTCGCTGGATCGTCTGGTGTGCGGCTGGCGATTGTCGCCAGCAGCTGGC

ACGGAAAGATCTGCGACGCGCTGTTGGACGGCGCCCGCAAGTGGCCGCCGGGTGTGGCCTCGATGACCGACTGTGGTT

CGGGTGCTCCGCGCGATCGATAT

Clone Rv275
::::::::::::Rv275SP6.seq::::::::::::
TCATCCCGACCAAAACGCGAGCTAGGTCGGCATCCGGGAAGCATCGCGACACCGTGGCGCCGAGCGCGCTGCCGGCAG (SEQ ID NO. 323)

GCCGATTAGGCGGGCATATTATCCCGCCGCGGCTCCCGGCTCCGAGTACGGCGCCCCGAATGGCGTCACCGGCTGGTA

ACCGCTCTTGCGCGCCTGGGCGGCGGCCTGCCGGATCAGGTGGTAGATGCCNACAAAGCCTGCGTGATCGGTCATCAC

CAACGGTGACAGCAGCCGGTTGTGCACCAAGCGCGAACGCCACCCCGGTCTCCGGGTCTGTCCAACCGATCGACCGCC

CAAGCCCACATGAACAAACCCCGGCATCACGTTGCCGATCGGCATACCGTGA

::::::::::::Rv275T7.seq::::::::::::
TTGGCGGGTTGGCCCAGAGCCCGCCCGGTGACGGCGACGATGCTGGGCTGGTTGCGGCCCTGCGCCACCGCGGCTTGC (SEQ ID NO. 324)

ATGCTGGTTGGCTGTCTTGGGACGATCCCGAAATAGTCCACGCGGATCTGGTGATTTTGCGGGCTACCCGCGATTACC

CCGCGCGGCTCGACGAGTTTTTGGCCTGGACTACCCGCGTGGCCAATCTGCTGAACTCGCGGCCGGTGGTGGCCTGGA

ATGTCGAGCGCCGTTACCTACGTGACCTGATGGATCGGGGGGTGCCGACCGTGCCCGGCGATGTGTATGTGCCGGGAN

AGCCGGTCCGGTTGCCACGCAAAGGCCATGTCTTCGTCGGTCCGACCATCGGTACCGGGACACGGCGCTGTATTGCCC

GGTTCGCTGCCGAGTTCGTCGCGCAACTGCACGCNGGCGGGCCAGCGGTGCTCGTTCANCCCGGAGGTTCCGGTGACG

ATGATCGTGTTGGTCTCCCT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv276
::::::::::::Rv276SP6.seq::::::::::::
GTAGGAGAGAACAAAGACCGTCGATAGGACACGTGTTACGCCGGTAGCTGTCATTGGTATGGGGTGCCGCTGCCGGGG (SEQ ID NO. 325)

GGCATCTACTCACCCGATCGGTTGTGGGAGGCGTTGCTGCGGGGCGACAATCTGGTCACCGAGATCCCCGCCGACCGC

TGGGACATCTACGAGTACTACGACCCCGAACCCGGCGTGCCCGGACGCACCGACTGCAAATGGGGCGCGTACCTCGAT

AACGTCGGCGACTTTGATCCCGAGTTCTTCGGGATCGGGGAGAAAGAAACGATAGCGATCGATCCGCAGCACCGCTTG

TTGCTGGAAACCTCCTGGGAAGCCATGGAACACGGCGGGCTAACACCGAACCATATGCCTCCCGACANGGGTTTTCGT

GGGGTT

::::::::::::Rv276T7.seq::::::::::::
CGAACTGAGCCCATAGAAAGGCAGCGACTAATTCGCTGGGCAAATAGGAAGACCCTTTGTCCTGCCACGTATATTTGT (SEQ ID NO. 326)

CGACCTCGTTGCGAAGGAAGCGGCTGCGATTGGTGCCCTTTTCCCTGGAGAATCTCTGCCCGGAGCAGGAAGTCTTAT

GAGTTGACAAGCAGGGGCGCCGCCTTCGCCGGAAATCACATTCTTGGTCTCGTGAAATGAGAGCGCTCCCAGGTCGCC

GATGCTGCCGAGCGCCCGCCCACGATACGACGCCATCGCGCCTTGGGCCGCGTCTTCGACCACCGCCAGGTTGTGGTG

CGTGGCGATCTTCATGATCGCGTCCATCTCGCAGGCCACCCGGCATAGTGAACGGGGACCATGGCCTCGGTTCGCGGG

TGAA

Clone Rv277
::::::::::::Rv277SP6.seq::::::::::::
CTTAGACGCCACCTCCGGGCCGAGCTCCACGGGGTGGATAAGTACGGCCGGATGTGGCCGCAATGGGAAGTTGTTGCC (SEQ ID NO. 327)

CGCTTGACTGTCCGGGTTAACGCCGGATTCCACCACATCCCCTTGCGAAAGGCCGTTGGGTT

::::::::::::Rv277T7.seq::::::::::::
GATCGCGATCGTCGATGTGGCCATCCGGCTTGGCGTCGACCCGCGTAAGGCAGACCAGATGGTTCGCGGCACGGTCAA (SEQ ID NO. 328)

CCTGCCACACGCACTGGTAAGACTGCCCGCGTCGCGGTATTCGCGGTTGGTGAAAAGGCCGATGCTGCCGTTGCCGCG

GGGGCTGATGCTGTCGGATCGACGATCTGATCGAGAGGATCAGGGCGGCTGGCTGGAATTCGATGCCGCGATCGCGAT

ACCGGATT

Clone Rv278
::::::::::::Rv278SP6.seq::::::::::::
AGCTTACGCCGCTTTCGCTTCNGATTTGGGACGCCGCATCGAAAGCGCAGTTGGAAGCGCGGCGCCCGGCTGGTCGAG (SEQ ID NO. 329)

CTGCTCAAGCAGCCGCAATCCCAGCCCATGCCCGTTGAGGAGCAAGTGGTTTCGATCTTCCTGGGCACCGGCGGTCAC

CTGGACTCGGTGCCCGTCAAGGATCTCGGCGGTTCGAAACCGAATTACTGGACCACATGCGGGC

::::::::::::Rv278T7.seq::::::::::::
CGACGGGACCTCGTCGCATCTTCCATAGCCCGCCACACCTTCAGTTGCTCACCGGAATCCAACCGGTATAAGGTCGGC (SEQ ID NO. 330)

GAAGCGCTCGGCATTGGTCATCGGGATATGCCGCTCGGGACGGTCAGATGCCCTCGGGTCCNGCCAGCACTCCTCAGG

CTTCGTCGGGGTGGTCGCGACCGCATGGGCCACATCGCATTCACCAGGTCTGCGCGAATCACCAGCACGTANACGGTT

CCTTTCCTAAGCAACACCGAAATTTCAGGACCCGAATGCTCCGGGAAAACATGTCACGGTAAGTCCGGTATTCCGGGT

ACCGGTTGAGCATTGA

Clone Rv279
::::::::::::Rv279SP6.seq::::::::::::
CGGCATCGGTTTGGGCTGTCACCAGCAGTTGGTAGTTCTTCACTACTGTTGTTCGAGCGTCGAGCCGCCGCGCGTGTC (SEQ ID NO. 331)

GAGGTCGCCGGACGCGTACCCGCCAGGCCGGTCAGGGTGCCCTTCCAGTCCACGCNGCTGTGGTCGGCTAACCGCTTA

TCTTCAATCGAGACNATCGCCAGCTTCATCGTGTTGGCGATCTTGTCCGAGGGCACCTCGAACCGGCGCTGCGANTAC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

AGCCACGCGATCGTGTTGCCCTTCGCGTCGACCATCGTCGATACCGCAGGCACTTGCCCCTCGAGCAGCTGGGCCGAT

CCGTTGGCAACGACCTCAGAGGCACGATTGGACATCAGCCCTAGCCCGCCTGCG

::::::::::::Rv279T7.seq::::::::::::
CCGTCGANGCCGCCGACTTGGCTTGACCGACACCAACATGGCCTGAGGGTGTTCAACAAGACCGTGGCCGACGGGCTG (SEQ ID NO. 332)

AACATCACCATGAGCGGCATGAGCCACGCCACCGAGTTCATCATGTTGATCGCCGAAAACCATTGGCGGGTAGCGGAA

GAACGGTCGAGGTGCTCTACACCGAGTATTCGAAGTCGAAAGGCCAACCGCTGCTCAACGGCGTCAACATCATTTTCG

ACGGGTTTCTGCGAGGGAGGATGCCACGATGAACTGGATCCAGGTGCTGTTGATCGCGTCGATCATCGGGTTGCTGTT

CTACCTGTTGCGGTCGCGCCGAAGCGCGCGGTCCGTGCCTGGGTCAAGGTGGGCTATGTCTTGTTCGTGCTCCCGGCA

TCTATGCCGTGCTGAGA

Clone Rv27
::::::::::::Rv27SP6.seq::::::::::::
TTACACGNCCTGCTTCCGGCTCGTATGTTGTGTGGAATTGTGAGCGGATAACAATTTCACACAGGAAACAGCTATGAC (SEQ ID NO. 333)

CATGATTACGCCAAGCTATTTAGGTGACACTATAGAATACTCAAGCTTTTTGAGCGTCGCGCGGGGCAGCTTCGCCGG

CAATTCTACTAGCGAGAAGTCTGGCCCGATNCGGATCTGACCGAAGTCGCTGCGGTGCAGCCCACCCTCATTGGCGAT

GGCGCCGACNATGGCGCCTGGACCGATCTTGTGCCGCTTGCCGACGGNGACGCGGTANGTGGTCAAGTCCGGTCTACN

CTTGGGCCTTTGCGGACGGTCCCGACGCTGGTCGCGGTTGCGCCGCGGAAAGCGGCGGGTCGGGTGCCATCAGGAATG

CCTCACCGCCGCGGCACTGNACGGCCAGTGCCGCGGCGATGTCNGCCATCGGGACATCATGCTCGCCTTCATACTCCT

CGACC

::::::::::::Rv27T7.seq::::::::::::
CAGGCATGCAAGCTTTGTCACACCAAGTGTTTCGACCAGGCGCTCCATCCGGCGAGTGGATACTCCCAGCAGGTAGCA (SEQ ID NO. 334)

GGTCGCCACCACGCTGGTCAGTGCGCGTTCAGCTCGCTTGCGGCGCTGCAGCAGCCAGTCCGGGAAATAGCTGCCCTG

GCGCAGCTTGGGGATCGCGACGTCGATGGTTGCGGCACGGGTGTCGAAATCACGGTGGCGGTAGCCGTTGCGCTGATT

GGACCGCTCATCGCTGCGTTCGCGGTAGCCCGCCCCGCACAGGGCGTCGGCTTCAGCCCCCATCAAGGCGG

Clone Rv280
::::::::::::Rv280SP6.seq::::::::::::
AGCTTAGCCAGTTTTCTACTCTTGGGCCCACACCCACAGTGCTTCGACGGTACGGTCACCCATGATGGCCATCCAGT (SEQ ID NO. 335)

TGGCATCGGTGAGCTGATAAATGCCAGCTGGTTTCGCCAACCCGGTAGCGATCTTGGCGCGCTGCTTGTTGTCACTGA

TACCTATCGAGCAAGACAGCCCGGTTTGCGACAAGATGACTTTTCGGATCTCTTCGGCGACTTCGATGGGGTCGTCGG

GAGTCCCGGGCGCCACCGCGAGGTAAGCCTCGTCCCAGCCCCATACCTCGACCGGGTATCCCAGGTCGCGCAATAACG

CCACCACCTCCTCGGACGCCGCGTTGTAGGCGGCTGGGTTCGACGGCAAGAAGTGGCCTCAGGGCATCGTCGGCGCGG

TCCCAACGGCNTGCCGGCGCGCACACCGTAGGCGCGGGGCTC

::::::::::::Rv280T7.seq::::::::::::
CCGGCGGAACTCAGACGTGCTGGTGGTGCGGCATGGCACCGCGGGCAGCAAAGCGCACTTCTCCGGGGACGACAGCAA (SEQ ID NO. 336)

GCGACCGCTAGACAAGAGGGGTCGTGCGCAGGCAGAAGCGTTGGTACCACAGCTGCTGGCGTTCGGCGCCACCGATGT

TTATGCCGCCGACCGGGTGCGCTGCCACCAGACGATGGAGCCACTCGCCGCGGAACTGAACGTGACCATACACAACGA

GCCCACCCTGACCGAAGACTCCTACGCCAACAACCCCAAACGCGGCCGACACCGAGTGCTGCAGATCGTCGAGCAAGT

AGGCACACCCGTGATCTGCACGCAGGGCAAGGTCATTCCCGATCTGATCACCTGGTGGTGCGAGCGCGACCCTGTGCC

CCCGACAGTCCCGCAATCGCAAAGGCAGCACGTTGGTGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv281
::::::::::::Rv281SP6.seq::::::::::::
GTATGGTCAGCTGTCCATCCGGCGCTGTCGGCCGAGCTGCCAGATCTCGTCAGCCGTAACCGGGTTGCGGGATCCACG (SEQ ID NO. 337)

CGTGCGGGTTGTCTAC

::::::::::::Rv281T7.seq::::::::::::
CCGACTTTCCGCGGGTACCCGCTCAACTTTGTGTCNACCTCAACGCCATTGCCGGCACCTACTACGTGCACTCCAACT (SEQ ID NO. 338)

ACTTCATCCTGACGCCGGAACAAATTGACGCAGCGGTTCCGCTGACCAATACGGTCGGTCCCACGATGACCCAGTACT

ACATCATTCGCACGGAGAACCTGCCGCTGCTAGAGCCACTGCGATCCGTGCCGATCGTGGGGAACCCACTGGCGAACC

TGGTTCAACCAAACTTGAAGGTGATTGTTAACCTGGGCTACGCGACCCGGCCTATGGTTATTCGACCTCGCCGCCCAA

TGTTGCGACTCCGTTCGGTTGTTCCAGAANGTCAGCCCG

Clone Rv282
::::::::::::Rv282SP6.seq::::::::::::
GCACCGATGTCGGCGAGCACTTCGTCAACTTCCAGGGGTGCCCGCACCAAGTATTTCGACGAGTATTTCCGTCGGGCC (SEQ ID NO. 339)

GCCGCCGCCGGTGCGCGGCAGGTGGTCATCCTGGCGGCGGGGCTGGGACTCGCGCGCGTACCGGCTGCCTCGGC

::::::::::::Rv282T7.seq::::::::::::
TGCACCCAACTTACTGAGCATGCTAACGCTGGTCGTGCGGGTCTTGTTCCCGCGTGTCGGCAGGGCACACGCTCGGGG (SEQ ID NO. 340)

CGTAGCTGGGAGAGGCCCCGGTCAAGCCCGGAGAGCAGTGCTCAGTCCGCCAGCTTGACCGACTTTCGATGAGAACGC

GCTTCTCGCCGTATTGAACTGGCGTGCTGACGGTCGCTGAGCAGCGCTCGCCGAGTGCGGCCGCTGATTCTTTCATCG

AGCCAGGACGCGCATTCGTGTTCGGCCGC

Clone Rv283
::::::::::::Rv283SP6.seq::::::::::::
AGCTTACGGCCGGTCGACGCGACGAGTGGTTCATGACACCACAAACCGTCAACGCCTACTACAACCCGGGGATGAACG (SEQ ID NO. 341)

AAATCGTCTTCCCGCAGCGATTTTACAGCCACCATTTTTCGATCCGCAGGCCGACGAGGCCGCCAACTACGGCGGGAT

CGGGGCGCGTGATCGGGCACGATGATCGGGCACGGTTTCGACGATAGGGCGCCAAATACGANGGCGACGCAATCTGGT

CNATTGGTGGATCGA

::::::::::::Rv283T7.seq::::::::::::
ATGTCGTCACGTCACCACAATCGCGAGGACCCAATCATGCCGCCCAGGGCGGCCAACCCAATGGTGGCCGCGAAGCGG (SEQ ID NO. 342)

CAGCTCGATCGCAGCGCGGAGGTGCCGGCCGCCAGTTGATTCACGAACAGGGTGAGGTCATAGGCGGGCAGGATAGTG

ACGAACGCAAGACCTATATCTGCCGTCGGAGTAAGAATCGAGTAGCCGGTCGACCAACGGAAGCGAAAGTCTCCGCGA

TGTTGATGAGCGTCGCCGGTTGTGGCGGCGGTGGC

Clone Rv284
::::::::::::Rv284SP6.seq::::::::::::
AGCTTCACCAGCGTGCCGATGCTGTTCGCNACACCTCCCTACTATGCGCAATTCGCCGACACGGGTGGCATCAACACG (SEQ ID NO. 343)

GGCGATAAGGTGGACATCGCTGGGGTGAACGTCGGGCTGGTGCGCTCGCTGGCAATCCGCGGCAACCGCGTGTTGATC

GGATTCTCGTTGCCCGGCAAGACAATCGGGATGCAAAGCCGGGCAGCAATTCGCACCGACACCATTCTTGGCCGTAAG

AACCTGGAAATCGAACCCCGCGGTTCGGAGCCGTTGAAACCCAACGGTTTCCTGCCGTTGGCGCAGAACACTACGCCA

TACCAAATCTATGACGCGTTCGTC

::::::::::::Rv284T7.seq::::::::::::
CTGCCGCGGTGGCGGTCAGCGCCTGGCAAGTCACCGCACCGCCGTCCGGTTCATCGGCAGGCTCCCCCGAAAAGGGCC (SEQ ID NO. 344)

CTGGCAACAGAAGGTGATCAATGAGCTCCCGCAGACCTTCGCCGATCTGGGACCGACATACGTGAAGTTCGGCCAGAT

CATCGCGTCCAGCCCGGGAGCATTCGGTGAGTCGCTGTCGCGGGGAATTCCGCGGCCTGCTCGACCGGGTGCCGCCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAAAAACCGACGAGGTGCACAAGCTCTTCGTCGAGGAACTCGGCGACGAGCCGGCCCGGCTGTTCGCCTCCTTCGAGG

AAGAACCGTTCGCGTCTGCGTCCATCGCCCAAGTGCACTACGCGACCTGCGCAGCGGCGAAGAAGTGTGGTCAAGATC

CACGGCCGGGCATCCGCCGCCGCGTTT

Clone Rv285
::::::::::::Rv285SP6.seq::::::::::::
GATCGTGCCGGCCCCCCGGCGGCAGTAGCAGATCAGCTCGTCGAAATCGCGGCAACCAGTCCAGTCGATTTCCATACG (SEQ ID NO. 345)

GGCGCCGTCAATCAACTCTGCGAACATCGCGATCGGCACCGGAAACCGGCGAGCCGCGTCAGCCAGCGCAACCAGCAC

CGGGATCGGATGAATCATCAATATTATCAAGTGATTTCCTGATGGCATCGAGCTCGGTGATCTTGGTCTCGGGGGCCA

GCTCGCCGTCGGCGACGTCGTCGATCCGGCGGCCGAGCGCATAGACCGCAAATAGTGCCGCTCGCTTTTCGCGCGGCA

AGAGTCGGATGCCGTAATATANGTTTCTGGCGGCCGTGCGCGTGATCNACTCGGTGATTCGATACGCCTGTTCATCTC

GGTCATGCCGTCCTC

::::::::::::Rv285T7.seq::::::::::::
GGTGGCGCAATGACCGAAACCACCCCAGCCCCGCAAACCCCGGCGGCCCCGGCCGGGCCCGCACAATCGTTCGTGTTG (SEQ ID NO. 346)

GAGCGGCCCATCCAGACCGTTGGGCGCCGTAAGGAGGCCGTGGTACGAGTGCGGCTGGTGCCCGGCACCGGCAAGTTC

GACCTCAACGGCCGCAGCTTGGAGGACTACTTCCCAAACAAGGTGCACCAGCAGTTGATCAAGGCACCCCTGGTCACC

GTGGATCGGGTGGAAAGTTTCGACATCTTTGCCCACCTGGGCGGCGGCGGCCCGTCGGGTCATGGCCGGCGCGCTGCG

CCTGGGTATCGCCCGGGCATTGATTCTNGTATCGCCGGATGACCGGCCCGCGCTGAATAANGCCGGCTTCTTGACCGT

GATCCACGCGCCACCGAACGCAAA

Clone Rv286
::::::::::::Rv286SP6.seq::::::::::::
CACAATAGATTACTCAAGCTTCGAACCAGCGGCCTTATCACGTATCCCCGCTGAGACCTTGACCCTTAGGGCCGAAGT (SEQ ID NO. 347)

GACTTCGCTGCTGCTATGCCGACACCCGATTTCCAGACGCTGCTGTTACACGACGGCCGGGCCGGTGGCCACCATCAC

GCTCAACCGCCCGGAACAGCTCAACACCATCGTCCCGCCCATGCCCGACGAGATCGAGGCCGCTATCGGGTTGGCCGA

GCGCGACCAGGACATCAAGGTCATCCTGCTGCGCGGTGCCGGCCGCGCCTTCTCCGGCGGTTACAACTTCGGCGGCGG

GTTCCAACATTGGGGGCAT

::::::::::::Rv286T7.seq::::::::::::
TCAGGACGCTTATGGTTGGCAGATGGTCGCCCTGGCGTCGAATACGCGCGAGCGCATGAGCTCACCGGTTCGGAACAA (SEQ ID NO. 348)

CGTATCGAAGAACGTCGCACTGCTGGCAGATGGTATCTCCGATGTGGTTGTAATTTGTATCCCAACTCTAACTGTGCT

ATCGGATCAGCGTGAATATCGAGATATTGCGAATGCGATGACAGGCCGCCATTCGGTTTATTCGCTTACGCTTCCCGG

GTTCGATTCGTCTGATGCACTGCCGCAAAACGCGGATATGATTGTTGAAACCGTATCTAACGCAATTATTGATGTGGT

AGGCGGCAGCTGCCGTTTTGTGCTGTCGGGCTATTCATCGGGTGGGGGTGTTTGGCTATGCCCTCTGCTCCCAT

Clone Rv287
::::::::::::Rv287SP6.seq::::::::::::
CGCAGCTGTCGCCGATCTGGTCCGGAATACCTAGCTCCAGGTTCTGAGTGGAGATGAGTGCGGCCATCGAAGTGTTGT (SEQ ID NO. 349)

CAATGTACTCCAGGATGTCAGGTGCCAGGCCGCTGGCGAGGATCTTGGGCACCGCCGCCATGACTTGGTCGAAGTCGG

CGAACGGGGCGAGCACGCTGGCGTCGTGGTC

::::::::::::Rv287T7.seq::::::::::::
GTAGTTCGTTCATCCAAACACAGTGCGGTACCGGCTCAAGCGGATCACCGACTTCACCGGGCGCGATCCCACCCACCC (SEQ ID NO. 350)

ACGCGATGCCTATGTCCTTCGGGTGGCGGCCACCGTGGGTCAACTCAACTATCCGACGCCGCACTGAAGCATCGACAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAATGCCGTGTCATAGATTCCCTCGCCGGTCAGAGGGGGTCCAGCAGGGGCCCCGGAAAAGATACCAGGGGCGCCGTC

GGACCGA

Clone Rv288
::::::::::::Rv288SP6.seq::::::::::::
TCCGCTCGCTTCTCCGAGAGGTTGAGTGCCAACGCTCTGCCGATGCCCGAAGCCGGCCCCGGTGATGACGGCGACCTT (SEQ ID NO. 351)

GCCTTCGAATGAGCTCATTTGACTACTCCCCGTGGTTGTCCCTGCGATTGGTGGAGGTGGCCGCGCAGCCTTGCCCCG

AGGTCGGCGATCGCGTCTCGGGCTTCGGGGAGCAGACTGACCTGCAGATGGAAGTCGTGCCACATGCCCGCGAACCGG

CGATGCTCGATGCTTGTTTTCGAAGCGGCGCAGGCGGTTTCGATCTTGTCCGCGTCAACACNGATCGGATCGTCGCCC

GCGGTCTGCATGACGAATGGGCG

::::::::::::Rv288T7.seq::::::::::::
ATGGGAGGCCACCGATTACCATCTTGCACACACCGATTCCGGGCTATTGATGTCCACGTTCGGTCCGCGAACCGCGCT (SEQ ID NO. 352)

GTGGCTGCTGCTGGCCAAAGGCGGAGGCGATACCGAAGTCAGTGCCCAAGCTTGGGTTCCACGCTCGCGCAGCCACGC

CGTCACCTTTCCACGAGACCTCACCTGCCGATCCGAAATGGAATCGGCCGTGACGGAATTGGCGCAGCGAACACTCAA

CGAGGTGGTGGCTTCGTCGCGAACCGTCACCCGAGTCGCGGTCACCGTCCGCACGGCGACGTTCTACACCCGCACCAA

GATCCGAAAGCTGCAAGCTCCCAGCACCGATCCCGACGTCATCACCGCTGCCGCCCGGCACGTTCTTGAACCTATTCG

AGCTGGAATCGGCCGTCCGGTTGCTGGGAATTGCNGTTAAGAACTGGGCCT

Clone Rv289
::::::::::::Rv289SP6.seq::::::::::::
GCTTTGCGCGCTTCTCCGAGAGGTTGGAGTGCCAACGCTCTGCCGATGCCCGAGCCGGCCCCGGTGATGACGGCGACC (SEQ ID NO. 353)

TTGCCTTCGAATGAGCTCATTTGACTACTCCCCGTGGTTGTCCCTGCGATTGGTGGAGGTGGCCGCGCAGCCTTGCCC

CGAGGTCGGCGATCGCGTCGCGGGCTTCGGGGAGCAAACTGACCTGCAGATGGAAGTCGTGCCACATGCCCGCGAACC

GGCGATGCTCGATGCTTGTTTTCGAAGCGGCGCAGGCGGTTCGATCTTGTCCGCGTCAACGCAGATCGGATCGTCGCC

CGCGGGTCTGCATGAAGAAT

::::::::::::Rv289T7.seq::::::::::::
CTCACGCAGCCACGCCGTCACCTTTCCACGAAGACCTCACCTGCCGATCCGAAATGGAATCGGCCGTGACGGAAATTG (SEQ ID NO. 354)

GCGCAGCGAAACACTCAACGAGGTGGTGGCTTCGTCGCGAACCGTCACCCGAGTCGCGGTCACCGTGCGCACGGCGAC

GTTCTACACCCGCACCAACATCCGAAAGCTGCAAGCTCCCAGCACCGATCCCGACGTCATCACCGCTGCCGCCCGGCA

CGTTCTTGACCTATTCGAGCTGGATCGGCCCGTCCGGTTGCTGGGAGTGCGGTTAGAAACTGGCCTAGAAACCGGCGG

GCACACCGCACCTGGGCGGGGN

Clone Rv28
::::::::::::Rv28SP6.seq::::::::::::
TGCTTCCGGCTCGTATGTTGTGTGGAATTGTGAGCGGATAACAATTTCACACAGGAAACAGCTATGACCATGATTACG (SEQ ID NO. 355)

CCAAGCTATTTAGGTGACACTATAGAATACTCAAGCTTGATGCCGCCGAAACCGAGCGTGAGCACGCCGCCAGCCACC

ACNCGCGGGTCGGGCGCCGGGCCCGGGTCGCCANGCTGCTCCCGCTCGGTGATGGCACGCCACCGCGACACCACCCGGC

TGCGCTACGTCGAGCCATACCGGGCGGAGCTACATCGGCTCGGCCGCCCAGTGTTCGGGCCCTCTTTCGAAGTCGAAG

TCGATACCGATTGCGCATCCGCNGCCGCA

::::::::::::Rv28T7.seq::::::::::::
CAGGCATGCAAGCTTCACGTCCGTACGGCTCGGGTACGCTTCGGTCGCAGTGTGCGAGTGATAGATGACGACCGGGAC (SEQ ID NO. 356)

CTCGTCTGCATCTTCCATAGCCCGCCACACCTTCAGTTGCTCACCGGAATCCAACCGGTAGAAGGTCGGCGAGCGCTC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GGCATTGGTCATCGGGATATGCCGCTCGGGACGGTCAGAACCCTCGGGTCCGGCCAGCACTCCGCAGGCTTCGTCGGG

GTGGTCGCGACGCGCATGGGCCACC

Clone Rv290
::::::::::::Rv290SP6.seq::::::::::::
GCTTGTCTATCGTCCCGGCCAGGTCCGGCCAGTCAAGGTCGAACGCCAGTCCGGTCTCCTCTCCGACTACGGCCAAGA (SEQ ID NO. 357)

ACTGGGCGACGGTGTCAGTGCAGACCAGCGGAAACTGGTGGCGCCCTAGGCGAGCGACCGCCTCACAAACGGCGGTGA

CCGCGTTCTGGTCGTGCACCATCGAGCCGTGCCCAGCCCGGCCGCGTGCCGTCAGCCGCATCCACTGGATGCCCTTCT

CGGCGGTTTCAATCAGGTACAGGCGACGTTCGCCACCATCGTGCCGGGGCACGGTTAGCGAGAAACCGCCGACTTCAC

GATTGCCTCGGTGATGCCGTCGAAACAGATCGGGCCT

::::::::::::Rv290T7.seq::::::::::::
GCGCGCCATGTTGAGGTTGTCCGACGGTGACGACGGTGAACCACAACTGTTTGACCTGTCCGCACACACCGTGTGGAT (SEQ ID NO. 358)

CGGCGAGCGGACCCGACAAATCGATGGCGCGCACATCGCGTTTGCCCAGGTGATTGCTAATCCGGTCGGGGTCAAGTT

GGGCCCCAACATGACCCCGGAACTGGCCGTGGAGTACGTCGAGCGGCTCGACCCGCACAATAAGCCGGGCCCGCTGAC

TTGGTGAGCAGGATGGGCAACCACAAGGTCCGCGATCTGTTGCCACCGATCGTGGAGAACGTCCATGCCACCGGGCAT

CAGGTCATCTGGC

Clone Rv291
::::::::::::Rv291SP6.seq::::::::::::
TTGCCTTCCATGCCGAGCAAGGTCGACTCAGCGATGACGAATTGTTCTTCTTCGCGGGTGTTGCTGCTGGTTCCGGGC (SEQ ID NO. 359)

TATGAGAGCACTGCTCATATGATTAGCACATTGTTTCTGACGCTGGCCGACTATCCAGATCAGCTGACACTCCTTGCG

CAGCAACCAGACCTGATCCCGCCGGCGATCGAGGA

::::::::::::Rv291T7.seq::::::::::::
CGACGCTGGGCCCAACTGCGACCACCAGGTCCTGGTATGGCAGGACATGGCCGGGTTCAGCGGCGCCAATACCG (SEQ ID NO. 360)

Clone Rv292
::::::::::::Rv292SP6.seq::::::::::::
TAACGACTCGGGTCCAGCGACCCCGCCAACACNAACGGCCGGACNACGTGGGCCAGGGTCGCGGCCTCCCCTACAAAC (SEQ ID NO. 361)

AGGATCCGTTGCCTGCGAACGACAGGCTCCGGTCCGGCGTTGGGCGCCGTGCTCGTCCCAGCGTCCGGTCCCGGGTCG

CCGGCGACGCTTGTTTCCTCCATACTCGCCCCCTAATCTCGAGGCAGCCCGTACCCGCAGGCAACCTCCCAAAAATGC

AATCCCCCAAAATGCAATGCGTCNAGCTATTTCTCACACCGACCGCTAGTTGCGGATCANAAATCCGTTGGGCGCGGA

::::::::::::Rv292T7.seq::::::::::::
CNTGGCGGTGGGTGCGGTGTCGAACACGACCACACTTCTTTGCGGTTCGGTGATCTCGACACCGGCCGCGAGCCGACC (SEQ ID NO. 362)

ACCATGCGCGCGTAGATCGGCGATCAGCGCGTCGGCTATCGCCTGGGTGCCGCCCACCGGAATCGGCCAGCCGACCGA

ATGGGCCAGCGTTGCCATCATCAGTCCGGCGCCGGCCGACACCAGTGACGGCAACGGTGAAATCNCGTGGGCGGCAAC

GCCGGTGAACAACGCGCGGGCATCCTCGCCCGCCAGCGACCGCCAGGCAGGGGTGCCCTGGGCCAGCATCCGCAGCCC

GAGACNCAGGACCGANCCCAGTG

Clone Rv293
::::::::::::Rv293SP6.seq::::::::::::
GCTTTTCNGATCGCAGCGAGTCGTACCCGCGCCGGTCACCTTCGTGGATATCGCCGGCCTGGTCAAGGGGGCGTCCGA (SEQ ID NO. 363)

GGGAGCCGGCCTGGGTAACAAGTTCCTGGCTCATATCCGCGAATGCNACGCCATTTGTCAGGTGGTGCGGGTGTTCGT

CAACAACNACTTGACTCATGTCACCGGACGGGTCGATCCCCANTCCGACATTGAGGTCGTCGANACCGAGCTGATCCT

GGCANATCTGCAAACCCTGGAGCGGGCCACGGGCCGGCTGGAGAAGGAANCGCGCACCAACAAGGCGCGCAAGCCGGT

CTACGACGCGGCACTGCGTGCCCAGCAGGTGCTCGACGCCGGCAANACGCTGTTCGCCGCGGGGGTGGATGCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

:::::::::::::Rv293T7.seq:::::::::::::
GTCGTACGCCATTNGTCGGTGTGCGCATACCAGTACGACGCGCCGGGCACCTGACGCGGCGGCCGCCACCAGTCGGTG (SEQ ID NO. 364)

GCCATCGCCATCGTCTGCCACCCGGTCAACGGACGCACCTTCTCCTGGCCGACGTAGTGCGCCCACCCGCCGCCGTTG

CGTCCCATCNATCCGGTCAACATGAGCAGCGCCAACACCGAGCGGTACATGACATCGCTGTGGAACCAGTGACAGATT

CCGCCGCCCATGATGATCATCGACCGTCCTCCGGATTCGGTCGCGTTGCGGGCGAAATTCCTTGGCAAACCGGATTGC

CTGCGCGGCCGGCACACCGGTGATCGACTCCTGCCAGGCCGGGGTGTTCTGCTGGGTTCGGTCGTGGTACCGGT

Clone Rv294
:::::::::::::Rv294SP6.seq:::::::::::::
GCGAGGCGGTATCGCTTCCCGTCGTACCGGCGACCGCCAGCCGAGAAGCTCGTTTTCCCAGTGTTCCTGGGGATTCTC (SEQ ID NO. 365)

ACGCTGCTGCTGANTGCGTGCCANACCGCTTCCGCTTCGGGTTACAACGAGCCGCGGGGCTACGATCGTGCGACGCTG

AANTTGGTGTTCTCCATGGACTTGGGGATGTGCCTGAACCGGTTCACCTACNACTCCAAGCTGGCGCCGTCTCGTCCG

CAGGTCGTTGCTTGCGATAGCCGGGAGGCCCGGATCCGCAATGACGGATTCCATGCCAACGCTCCGAGTTGCATGCGG

ATCGAATACNAATTGATCACCCA

:::::::::::::Rv294T7.seq:::::::::::::
TGGGTCTTGCCGGCGAGCCCAGCGAAGTCGCTAGCGTGGCCGTGTTTCTTGGCTTCGGATCTATCCTCGTTACATGAC (SEQ ID NO. 366)

CGGCACCGTGTTGGACGTGACTGGCGGCCGGTTCATATGACACCGAGATCATTGCCACGGTACGGCAATTCGTCAAGA

AGGAAATCTTTCCCNATGCACCGGCCCTCGAACGTGGCAACAGCTACCCGCAAGAAATCGTCGATCGGCTGGGTGTTA

TTGGCTTGCTCGGTCGCCGGCTGCAAGGGTATCGACACCACCGAGTTCATTCTCGGGCGTGCCGGCGCATTCGAGCTG

GCGGTGCGCGCTGCCCAGCACCGTCATAAGTACTTGANGATGGTCAAACGTCGGACGAACCGCCACCACGTCGCTGCC

GAACGG

Clone Rv295
:::::::::::::Rv295SP6.seq:::::::::::::
TAGATGCCCAAGCTTGCCNTTANAGACCTCGTCGACCAAGCACGGACGCGACCGTCGAAGGTGGCGAATCCGGGCTTG (SEQ ID NO. 367)

GCGTCNACCCGCGTAAGGCAGACCAGATGGTTCGCGGCACGGTCAACCTGCCACACGGCACTGGTAAGACTGCCCGCG

TCGCGGTATTCGCGGTTGGTGAAAAGGCCGATGCTGCCGTTGCCGCGGGGGCGGATGTTGTCGGGAGTGACGATCTGA

TCGAGAGGATTCAGGGCGGCTGGCTGGA

:::::::::::::Rv295T7.seq:::::::::::::
TCTCCACGGCGTGGATCAAGGTACCGGCCGGGATGTTGCGCAATGGCN3GTTGTTGCCCGGCTTGATGTCTGCGTTAG (SEQ ID NO. 368)

CGCCGGATTCCACCACATCCCCTTGCGAAAAGTCCGTTGGGTGCAATGATGTAGCGCTTCTCCCCATCGAGATAGTGG

AGCAACGCAATCCGTGCGGTACGGTTCGGGTCGTACTCGATGTGCGCGACCTTGGCGTTGACACCATCTTTGTCATTG

CGGCGAAAGTCGATCATCCGGTAAGCGCGCTTATGACCGCCGCCTTTGTGCCGGGTNGGTAATCCGGCC

Clone Rv296
:::::::::::::Rv296SP6.seq:::::::::::::
GCCCGGTTCGATCGGGCATGTCCGCAGTCGTCGTTACCGGAGGCGGTCGTGGCCGCGCTAATCGGCGTCGGCGCCGAC (SEQ ID NO. 369)

AAGATGTGGGATATCCGCAATCGGGGCGTCATCCCTGCGGGCGCGCTCCCCCGCGTCCGAGCCTTCGTCGACGCAATC

GAGGCAAGTCACGACGCGGATGAGGGGCAGCAGTGAATTACAGCGAGGTCGAGCTGTTGAGTCGCGCTCATCAACTGT

TCGCCGGAAACAGTCGGCGACCGGGGTTGGATGCGGGCACCACACCCTACGGGGGATCTGCTGTCTCGGGCTGCCGAC

CTGAATGTNGGTGCGGGCANCGCCGGTATCNACTCCCGTGGAACACAGCCGGGGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv296T7.seq::::::::::::
CTCGGCGTGGATATCGGTGTAGCCGGCGCCGGTGAANGTCGGCTCCTTACGTCCACTCGACAACAGCTCATAGCGATC (SEQ ID NO. 370)

CAACCAGTANGCAACCGCCTTCAGCAGTACAACCGCGCCGGCGAACACTGCGAGTTGAACGCGAGCTGCCTGGGTCAG

CATGCCTCTGCCGGTTGTCAGCCGAAGGCCGCCGAACAGGTAATGCGTCAACAGGCTCGCTAGAAACGCCAGAACCAC

GGCCACGAACAGCCAGTTCAGCACCGACCGGTAGAACGGCAGATCGAAGACGAAAAAACCCAATGTCATAGCCGAATT

CGGGGTCCACGATGCCAAAGGTGCCCCCGTGTACAACAACTGAACCTTGACCCA

Clone Rv29
::::::::::::Rv29SP6.seq::::::::::::
TCCGGCTCGTATGTTGTGTGGAATTGTGAGCGGATAACAATTTCACACAGGAAACAGCTATGACCATGATTACGCCAA (SEQ ID NO. 371)

GCTATTTAGGTGACACTATAGAATACTCAAGCTTCACGTCCGTACGGCTCGGGTACGCTTCGGTCGCAGTGTGCGAGT

GATAGATGACGACCGGGACCTCGTCGGCATCTTCCATAGCCCGCCACACCTTCAGTTGCTCACCGGAATCCAACCGGT

AGAAGGTCGGCGAGCGCTCGGCATTGGTCATCGGGATATGCCGCTCGGGACGGTCAGAGCCCTCGGGTCCGGCCAGCA

CTCCGCAGGCTTCGTCGGGGTGGTCGCGACGCGCATGGGCCACCATCGCATTCACCAGGTCTGCGCGAATCACCAGCA

CGTAGACGGTTCCTTTCCTAAGCAACACCGAAGTTTCAGGACCGAATGCTCCGGGAAACATGTCA

::::::::::::Rv29T7.seq::::::::::::
CAGGCATGCAAGCTTGATGCCGCCGAAACCGAGCGTGAGCACGCCGCCAGCCACCACGCCCGGGTCGGGCGCCGGGCC (SEQ ID NO. 372)

CGGGCCGCCAGGCTGCTCCGCTCGGTGATGGCACGCCACCGCGACACCACCCGGCTGCGCTACGTCGAGCCATACCGG

GCGGAGCTCCATCCGCTCGGCCGCCAGTGTCCGGGCCCTC

Clone Rv2
::::::::::::Rv2SP6.seq::::::::::::
CCTGCATCCGGCTCGTATGTTGTGTGGAATTGTGANCGGATAACAATTTCACACAGGAAACAGCTATGACCATGATTA (SEQ ID NO. 373)

CGCCAAGCTATTTAGGTGACACTATAGAATACTCAAGCTTCCAATCCCCCTGCCCTGATACGCGTCGGCAACCGTGAA

CGCGATCTCGGCGACCGTCGGATCGGTTTCATCCCGCACAAAACGCGCGTCGGCTACGGGGTCGCTTCCGTCGGTCAC

CACCCAGACGAAGTGGTCGACGTAGTCGACTTCCGACAGGTAGTGCATCAACGCCGGACTGGGAACACNAGCCGACAT

GAACCGTCGATACAGCGTCTCNCCGGAGAACTGGATGTGTCCGTGCACGGTCCGCTCGCGGTCACCGGGCAGCACGGG

GCGTAACATCAGTTGAGTCCCGTCGGCAAGCCGTACCGGAATCGGGGAGACGA

::::::::::::Rv2T7.seq::::::::::::
CAAGATGATCGCCGGTGCCACCCCGATCCGTGCCTCGGTCAGCGCGAACGTGCTTTCCGGTCCGGCGACCACCATGTC (SEQ ID NO. 374)

GCACGCACCGACCAGGCCGAACCCGCCGGCCCGCACATGCCCGTTGATGGCGCCGACCACCGGCAGCGGCGACTCGAC

GATGGCGCGCAACAGCGCCGTCATTTCCCGCGCCCGCGCCACCGCCATCCGGTACGGATCACCACCACCACCGCCGGC

CTCGCTGAGGTCCGCGCCGGCGCAGAACGTTCCGCCGGTATGCCCCAGCACGACCAGCCGCACCGCCGGATCTGCTTC

GGCCGCACTCAGCCCTTGATGTAGTTGGCTGACCAGCGTGCTCGACAGCGCGTTGCGGTTGTGCGGAGAGTTCAGTGT

CAGCCTGGCGAAGGGGCCGCCGCAGGCGGCCGGGCCAGCGTAGTCGACGGGGCTG

Clone Rv301
::::::::::::Rv301SP6.seq::::::::::::
CTCAAGCTTCGATCGACAGTACTCCCGCCTTGGGTCTGGTCTTCGAGCTGGTCGGTCATGGTCGGACCTGCTCGTAGT (SEQ ID NO. 375)

GGGGATCTAACGCAACATGGTCGGGATTCATCATGGTGTACCCGTGATACCCATTCGCAGCTGCCGGTGAAACCCCGC

GATGCCGGGATTTCCAGCCGCACTAGGATGTCTAGCCGGCCAGCCGCTGCCGCCGGACTTCGGGATGTTCGGTATACC

ACCGATCGGCAATCTTGCNTATCCGCCGATGCTCGAACGCTAGCCACCCCAAACCAACCACTGTGACNACAATC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv301T7.seq::::::::::::
TGAATTTCCCGATCCCACAATCTCGGTTCAGATACAGGTCGCCATACCCCTTACTTCCGCAACGCTGGGCGGATTGGC (SEQ ID NO. 376)

CCTGCCGCTGCAGCAGACCATCGACGCCATCGAATTGCCGGCAATCTCGTTCAGCCAATCCATACCCATCGACATTCC

GCCGATCGACATCCCGGCCTCCACTATCAACGGAATTTCGATGTCGGAGGTCGTGCCGATCGATGTGTCCGTCGACAT

TCCGG

Clone Rv302
::::::::::::Rv302SP6.seq::::::::::::
TACTCAAGCTTGAACGCTGCGAGCGAGCCCATGTAGAGCGTTTGGTACCAAACCGATCGGTGGGCCAACTTGCCATGG (SEQ ID NO. 377)

GCTCACAGCGGCTATCGCGAGCGTGTAGCCGATCATCCGCCAGGCGACGGTGGCCTGAGCGGCAGGGGTTGCCTTATC

CATCCTCTTGCGGCATGGTTGCCGCAGGGAGTGCCGGTAAGTCTGGTCGGCAACCTGGCCCGCTGCGGGTTGGGTTCG

GATTCCCTCGGCTAGTAAGGTGCTCGCCTGGTGTTACAACGAATCGCTAGACAGCTCTTATCGGGAGTGGCCGTCGCG

ATCGTTGCGCTGCCGCTGGCGATCGCGTTCGGCNTTACCGCCACCGGAACGTCCCAAGGTGCGCTCATCGGGCTCTAC

GGCGCCATCTTCGCCGGATTCTTCCCNGCCGTGTTCGGTGG

::::::::::::Rv302T7.seq::::::::::::
GCGGTGTCTGAACTTCGCCCGTTCCCTCCAGCGCATTGAGCTTCAGCCCGACCGGCAGGTAGGGAGTCGGCATGCGGT (SEQ ID NO. 378)

CCTTCGCCCCGACCCCGCTGGCTAAATAGCCACCCCCGAGCGCGGTCACGGTCTTTGCACCGGGACGACGGCATACCG

GCAGCGCGAACATCGCCGCGGGCTGCAGCGTGAACGTCGAATACGAGTCGAACAGTGTCGGCGCGTAAAAACCCGAGC

CGGCGGTCGCTTCGGTAATCAACGGCTCCTGCGCAACCAGCTGCAANTCNCCGGTGCCACCGGCGTTGACAATCTTGA

TNTCGGCGACCTCGCGCACCAN

Clone Rv303
::::::::::::Rv303SP6.seq::::::::::::
TACTCAGCTTCGGCTCAGGTGGTGCTGCTGGTAAAGTTCNCTGAACGGTGCAGGTTTCGACAATGTGGTGCCGGTTCG (SEQ ID NO. 379)

GCGGGTACTGCCATCGAGACACTGGCGCAGGCTATCGCACCCGTTATCGGCTACAAACAAATCGCGGTATGCGTTCTT

GAGCATGAGTCGGCGACCGTCGTCATGGTCGACACCCACGACGGAAAGACGCAGATCGCCGTCAAGCNTGTGTGCCGC

GGATTATCAGGACTGACCTCCTGGCTGACCGGCNTGTTTGGTCNCGATGCCTGGCGCCCGGCCGGCGT

::::::::::::Rv303T7.seq::::::::::::
CATCACCTGGTTCATGAAACTGGAAGCAGCGCAGCGCTTCCTTTTCGGCCGCAACATGAGCCAGCCTCTCGTCGGCGG (SEQ ID NO. 380)

TCGGGTGCAGGTGCTCGGGCAGCTCGGCCGCGACAGCCGCCTGACCCTGAAACCAGCTTCCATATCCCGCGACGAACG

ACGCCAGTCCGCTACGTAACCCCTCCGCGACTGTCCATGGACAACAMCGCGTTCTCCACCGACCGGGCCCGGGTGTGG

GGTGTT

Clone Rv304
::::::::::::Rv304SP6.seq::::::::::::
CTCAAGCTTCCCGGCGGCCAGTACCGAAAGCGCGAACAGCTCGCGGCAGCCCACAACNTGCTGCGTCGGATTGCCGGC (SEQ ID NO. 381)

GGCGANATCAATTCCAGGCAGCTCCCGGACAATGCGGCTCTGCTGGCCCGCAACGAAGGACTCGAGGTCACCCCGGTG

CCCGGGGTCGTGGTGCACCTGCCGATCGCACAGGTTGGCCCACAACCGGCCGCTTGATGCCCGGTCGGCAAGCCCGGC

AGTTGCCAAACCCAGCGTGATCAGGCTCGGCTCGCGAGTTCGGCGAAGAAGTGGCTCGCCTGATCACCTACCATCGGC

CAGGATCTGCGTGTCATCACNACGCTCGCCAAGGAGGTTGTTGTGGTGCT

::::::::::::Rv304T7.seq::::::::::::
GCCACGTTTCGCGCCGCCCGGCATACGGCGGCGTACCGATCTCCGCGTCATACACCCGCGGGTAATCGCCGACGGTGC (SEQ ID NO. 382)

CGGTTCGCGAGCCGAAGGTGACGACGCTGATTGAATCGAGTTCCAGGTCCAGCGGGTGGCGCAGCAACGGCGCGAGCT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAACGACGTCAATCACGTTGTCGCTTTCTACGGTCACCGACCCGGTGACCGTAGTCGCCCGGTGCGCTCGGCCGAGAA

GTTGCACCGCCACCACCGCGACACCGTCTTGCACGCGGACGCCACCCCCGGATCGGTTGTTGGCCAAGGTAATTGGGT

CATTCCATTTGACGGGACGCCGACCCCGCAGCCCCAGTACCGCCCACGACCACGCCGGCTGACCCCACCACTGTACGA

ACACCAAGGCGACGCCGACCA

Clone Rv306
::::::::::::Rv306SP6.seq::::::::::::
CTCAAGCTTGATGCCGCCTAAACCGAAGCGTGAGCACGCCGCCACCCACCACGCGCGGGTCGGGCGCCGGGCCCGGGC (SEQ ID NO. 383)

CGCCAGGCTGCTCCGCTCGGTGATGGCACGCCACCGCGACACCACCCGGCTGCGCTACGTCAAGCCATACCGGGCGGA

GCTACATCGGCTCGGCCGCCCAGTGTTCGGGCCCTCTTTCGAGGTCNAGGTCNATACCGATTTGCGCATCCGCAGCCG

CACCCTGGACGACAGAACCGTGCCCTACGAGTGCTTGTCGGGCGGGGCCAAAGAACANCTTGGCATCCTGGCGCGATT

GGCCGGCGCGGTCCTGGTC

::::::::::::Rv306T7.seq::::::::::::
CTCGGGTACGCTTCGGTCGCAGTGTGCGAGTGATAGATGACGACCGGGACCTCGTCGGCATCTTCCATAGCCCGCCAC (SEQ ID NO. 384)

ACCTTCAGTTGCTCACCGGAATCCAACCGGTANAANGTCGGCGAGCGCTCGGCATTGGTCATCGGGATATGCCGCTCG

GGACGGTCAGAGCCCTCGGGTCCGGCCAGCACTCCGCAGGCTTCGTCGGGGTGGTCGCGACNCGCATGGGCCACCATC

GCATTCACCAGGTCTGCGCG

Clone Rv307
::::::::::::Rv307SP6.seq::::::::::::
CTCAAGCTTCAATTCCTCCACGACGCGTTCCCAAATGAATTTCCCGATCCCACAATCTCGGTTCAGATACAGGTCGCC (SEQ ID NO. 385)

ATACCCCTTACTTCGGCAACGCTGGGCGGATTGGCCCTGCCGCTGCAGCAAACCATCGACGCCATCGAATTGCCGGCA

ATCTCGTTCAGCCAATCCATACCCATCGACATTCCGCCGATCGACATCCCGGCCTCCACTATCAACGGAATTTCGATG

TCGGAGGTCGTGCCGATCGATNTNTCCGTCNACATTCCGGNGGTCACCATCACCGGCACCAGNATCGACCCGATTCCG

CTGAACTTCGACGTTCTCAGCAGCGCCGGAACCA

::::::::::::Rv307T7.seq::::::::::::
TTAACCCCCGTGGCCTCTACGCCGCCTNCGGGTCGAACATGCATCCCGAGCANATGCTCGAGCGCGCACCCCACTCGC (SEQ ID NO. 386)

CGATGGCCGGAACCGGCTGGTTACCCGGGTGGCGGCTGACGTTCGGCGGCGAGGACATCGGCTGGGAAGGGGCGCTTG

CCACCGTCGTCGAAGACCCAGATTCGAAGGTGTTCGTCGTGCTCTACGACATGACCCCGGCGGACGAGAAGAACCTTG

ACCGGTGGGAAGGCTCCGAGTTCGGGATCCACGANAAGATCCGATGCCGCGTT

Clone Rv308
::::::::::::Rv308SP6.seq::::::::::::
CTCAAGCTTGATTTTGATCATCATGGATGATCATCACCCGAAGTGTGGTAGCCGCAGTGGTTATCGTGGGTACCGTCG (SEQ ID NO. 387)

TGCTTTCCATGGGCGCCTCTTTCGGGCTTTCCGTATTGGTCTGGCAGGACATTCTGGGTATCGAGTTGTACTGGATGG

TGTTGGCGATGTCGGTGATCCTGCTCCTGGCGGTGGGATCCGACTACAATCTGCTGCTGATTTCCCGGTTGAAAAANG

AAATTGGGGCCGGATTGAACACCGGAATTATCCGTGCCATGGCTGGTACCGGGGGAGTGGTGACGGCTGCCGGCATGG

TGTTCGCCGTTACCATGTCGTTGTTTGTGTTCAGCGATTTGCGAATTATTGGTCAGAT

::::::::::::Rv308T7.seq::::::::::::
CGNCCAACCCGAATTGGTTTTCGGCGCCNTCGGTGAGGACGGCGTGCGGGTGCTCAACGACGACGTCGTCCGCGGGAC (SEQ ID NO. 388)

ACACCTCGATGCTGCCGCCATGGACGCGGTCGAACGCAAGCAGCTGATCGAGCTACAACGCCGCGCGGAACGCTTCCG

CCNCNGGCGTTACCGCATCCCGTTGACCGGGCGGATCGCGGTGATCGTCGATGACGGCATCGCCACCGGAGCGACCGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CAAGGCGGCGTGCCAGGTCGCCCGGGCGCACGGTGCGGACAAGGTGGTGCTGGCGGTCCCGATCGGCCCANACGACAT

CGTGGCGAGATTCGCCGG

Clone Rv309
::::::::::::Rv309SP6.seq::::::::::::
CGTGACTGCCACCGGGGCCACTCCGCAGAATCTGTACCCGACCAAGATCTACACCATCGAATACGACGGCGTCGCCGA (SEQ ID NO. 389)

CTTTCCGCGGTACCCGCTCAACTTTGTGTCNACCCTCAACGCCATTGCCGGCACCTACTACGTGCACTCCAACTACTT

CATCCTGACGCCGGAACAAATTGACNCAGCGGTTCCNCTGACCAATACGGTCGGTCCCACGATGACCCANTACTACNT

CATTCGCACGGANAACCTGCCGCTGCTAGAGCCACTGCGATCGGTGCCGATCGTGGGGAACCCACTGGCGAACCTGGT

TCAACCAAACTTGAAGGTGATTGTTAACCTGGGG

::::::::::::Rv309T7.seq::::::::::::
TCGCTCAAGCGCNTGAGGCCGAANCGGCTGGTTACGACTCCCTGTTTGTGATGGACCACTTCTACCAACTGCCCATGT (SEQ ID NO. 390)

TGGGGACGCCCGACCAGCCGATGCTGGAGGCCTACACGGCCCTTGGTGCGCTGGCCACGGCGACCGAGCGGCTGCAAC

TGGGCGCGTTGGTGACCGGCAATACCTACCGCAGCCCGACCCTGCTGGCAAAGATCATCACCACGCTCGACGTGGTTA

GCGCCGGTCGAGCGATCCTCGGCATTGGAGCCGGTTGGTTTGAGCTGGAACACCGCCAGCTCGGCTTCGAGTTCGGCA

CTTTCAGTGACCGGTTCAACCGGCTCGAAAAGGCGCTACANAT

Clone Rv30
::::::::::::Rv30SP6.seq::::::::::::
ATACTCAAGCTTCCGCTGGGGCCTGTTCAACCATGGCGATCCCGTTGGTCCCGGACATCCCGAACGAGGACACCGCGA (SEQ ID NO. 391)

CCCNCTTCGGTGTGTGATCATTACCGTTGGGCCACTGCGTAACCGCTTGCGGCACAAAGAGCCCGGTCTCGACGTCGG

AAAGCTCATCGGGCACCCGATTGAAATGCAGCAGCGGCGGCACCACCCCGTGCCGCAGTGACAGAATTGCCTTGATCA

GCCCGACGGTCCCCGCCGATGCCGTGCTGTGCCCCATGTTGCTCTTGGCCGATCCAAGCGCGCAGGGGGTGCCCGCGC

CATACACCCGCGCCAGGCTGCGGTACTCAATCGGGTCGCCGATTGGCGTACCGGTGCCGTGCGCCTCCACCACACCGA

CCGTTTCGGGCTG

::::::::::::Rv30T7PEG.seq::::::::::::
CAACAGCGTTCCAGCGGCATACCACCGCACATGCCGTGCACCCGGCGCCGGGCGGAGTCGCCGCATAACACANGTACA (SEQ ID NO. 392)

CCTTGGGAATCGGTGTGCGCCAGGGATTCNACCGCGGGGTGGGGCCGGCGATCGCGCGCCAGGTCGAGTTGGCGCCGA

CCGTGATNTCACCGCCGACGTAGTTGGCGTTGTGGTCCGCCATCCGCGCGGCGGGCACGGCGCGGGCCGCCACCACGA

TGTCACGGAAGCCGGGGGCGAACGCTCGACGACCTGGTTACCGTCTCNGTCGCNTCNANCGTGGACCCGACNCCACCT

GGGCATATGTCCANAACGGACGNGGCCGGTTTCNTCGATGCNGCCGGGGTCCGCGACNTGCGGACNCNCNGNCACACC

ATCCGCCAGTCCGCGTGGCGTCCCGCCGCGACTCTGCCTCGGCCGCGCCA

Clone Rv310
::::::::::::Rv310SP6.seq::::::::::::
CTCAAGCTTTGNCGACGATCGGGCGATGTCGATGANAGGAAACCCCAGCGCACAACCGACNATTTTGGCGTAGCCGGC (SEQ ID NO. 393)

GGACNTCTGCTCGATTCCGATCACGTCGGCGCTCGCATCGAGCATGGCGCCGGCGACGGCTAGCAGCGATCCGCCGTC

GTCGAGGAACACGACACGAGCCGTACGCCCGGCCGTAAGCCGCGCCCAGGATTCGGCGAAAAACCGTTCTACGTGGCG

GGTGTACTGGGTGTCCAATGATTCGTGGGGTGCGTAGGCGTCGCTGCAATCGTCGACATAAATGCCGTCGGCCCGCAT

CGCGTCAACAACTCCCGGGTGAGTGGAATANCACTTGCCGA

::::::::::::Rv310T7.seq::::::::::::
TCCAACGCGGTGACAGATTTGTCTATCCTGGACCTGACGGTGAGGTCGAAGTTTTCCAGGAATTCGGCAAAATCGGTA (SEQ ID NO. 394)

AGAGCCTGAAGAATTCGGTATCGCCGGACGAAATCTGCGACGCATACGGGGCAGATACGCTTCGGGTTTACGAGATGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGATGGGGCCGCTGGAGGCTTCACGTCCATGGGCCACAAAGGATGTTGTCGGCGCGTACCGTTTTCTGCAGCGGGTGT

GGCGCTTGGTCGTCGACGAGCACACCGGCGAAACTCGGGTGGCTGACGGCGTGGAACTCGACATCGATACGCTACGGG

CGTTGCACCGCACCATCGTCGGCGTGTC

Clone Rv311
::::::::::::Rv311SP6.seq::::::::::::
CTCGTCCTTGACTACGCCCAGTATCGAAANCCTCCTGTGCCGGTNCGCTAAACACCCGGCGGACACTCANACGGTGCT (SEQ ID NO. 395)

GGTGGTGCGGCATGGCACCGCGGGCAGCAAAGCGCACTTCTCCGGGGACGACAGCAAGCGACCGCTAGACAAGAGGGG

TCGTGCGCAGGCAGAAGCGTTGGTACCACAGCTGCTGGCGTTCGGCGCCACCGATGTTTATGCCGCCGACCGGGTGCG

CTGCCACCANACNATGGAGCCACTCGCCGCGGAACTGAACGTGACCATACACAACGAGCCCNCCCTGACCGAAGAGTC

CTACGCCAACAACCCCAAACGCGGCCGACACCGAGTGCTGCAGATCTTCG

::::::::::::Rv311T7.seq::::::::::::
GTATCGCCTCCNCCTTTGGCCACCAGCAGCCACAGCGCGGTTCGCGGACCGAACGTGGACATCAATAGCCCGGAATCG (SEQ ID NO. 396)

GTGTGTGCAAGTTGGTAAACGGTGTTGATCCCAAGCTTTGCCAGCCTTTTCGTAGTCTTGGGCCCCACACCCCACAGT

GCTTCGACGGTACGGTCACCCATGATGGCCATCCAGTTGGCATCGGTGAGCTGATAGATGCCAGCTGGTTTGGCCAAC

CCGGTAGCGATCTTGGCGCGCTGCTTGTTGTCACTGATACCTATCGAGCAAGACAGCCCGGTTTGCGACAAGATGACT

TTTCGGATCTCTTCNGCGAACTTCCAATGGGGGTCTCCGGGANT

Clone Rv312
::::::::::::Rv312SP6.seq::::::::::::
CTCAAGCTTTTGGTCTAGCCGGCCGAGCACGATACGGGTGTCCTTGGCCACCGGCGGCGGCTCTCCGGGAAATGGCGG (SEQ ID NO. 397)

GTCCCCGGTGGTTTTGCTGANGANTGCTGAACCGTAGTCGAAGTGGGCGGCGTCAGACTCCACCCAGCCAGCAGGCAG

CGCGAAGCTGAATCCTCCAACCGGGTTGTCGATCCGGACAGGTTGGGGTGCGTTTGGGGCAATGACAGGTGGCGGCGG

TGCGTTCGGGTCGGCCGGCGGAGGTGCTGCGTTGGGATCNCCCGGCTGGGCATTCGGCNTNTTGGCGGCGGCCGGTGG

TGGGGGGGCAACANGTGTCCCGGTGCGGGTGGCGCTGC

::::::::::::Rv312T7.seq::::::::::::
ATCTGTACCCGACCAAGATCTACACCATCGAATACGACGGCGTCGCCGACTTTCCGCGGTACCCGCTCAACTTTGTGT (SEQ ID NO. 398)

CGACCCTCAACGCCATTGCCGGCACCTACTACGTGCACTCCAACTACTTCATCCTGACGCCGGAACAAATTGACGCAG

CGGTTCCGCTGACCAATACGGTCGGTCCCACGATGACCCAGTACTACATCATTCGCACGGAGAACCTGCCGCTGCTAG

AGCCACTGCGATCGGTGCCGATCGTGGGGAACCCACTGGCGAACCTGGTTCAACCAAACTTGAAGGTGATTGTTAACC

TGGGCTACGGCGACCCGGCCTATGGTTATTCGACCTCGCCGCC

Clone Rv313
::::::::::::Rv313SP6.seq::::::::::::
CTCAAGCTTGCAATGCGGGTCGGGATGCCCATGGTTGGAANATGGTCGCCCTGGCGTCNAATACGCGCGAGCGCATGA (SEQ ID NO. 399)

GCTCACCGGTTCGGAACAACGTATCGAAAAACGTCGCACTGCTGGCAGATGGTATCTCCGATGTGGTTGTAATTTGTA

TCCCAACTCTAACTGTGCTATCGGATCAGCGTGAATATCGANATATTGCGAATGCGATGACAGGCCGCCATTCGGTTT

ATTCGCTTACGCTTCCCGGGTTCGATTCGTCTGATGCACTGCCGCAAAACGCGGATATGATTGTTGAAACCGTATCTA

ACGCAATTATTGATGTGGTAGGCGGCAGCTGCCGTTTTGTGCTGTCGG

::::::::::::Rv313T7.seq::::::::::::
CAAATACACGCCGGACGCACAGGCGGACATCGCCATCCCGAGCACACCCAAAACGGGATACAGGATCGAGGCCAACGC (SEQ ID NO. 400)

CACGGCCGCGCCCAGGATCACCAACCACACCGGCTTGGTCAGCTTGTCGGCGCGGTATAGGCATCGGGCCGCTGCCAA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGCAGCATGCACAAACGCGTACACCGCTGTCACCAAGACGGCGACCAGCAATACCAGCATGACGGTACCCACGAGGTG

GCTCACGCATTCAGACTATGCGGTTTGCATCCAACACG

Clone Rv314
::::::::::::Rv314SP6.seq::::::::::::
CTCGTCCTTCGGCCTCGCTGCAGGAGTGGGAGCCGCAGGGCTGGAAATCCGAAAAACGAGCCGGTGATCGCACTGTCG (SEQ ID NO. 401)

CCGATCGGCGCCGCACCTGGTTGGTGTTACGGATGAATCCGCAGCGAAATGTGGCTGCGGTGGCGTGTCGTGACTCGT

TGGCGTCGACGCTGGTGGCAGCCACCGAGCGGTTGGTCCAGGATCTGGATGGGCAAAGTTGTGCGGCCCGGCCGGTGA

CGGCCGATGAGCTGACCGAGGTCGACAGCGCCGTGTTGGCTGACTTGGAACCGACATGGAGTCGCCCCGGTT

::::::::::::Rv314T7.seq::::::::::::
GTCTAGNCCGCCGAACACGATACGGGTGTCATTGGCCACCGGCGGCGGCTGTCCGGGAAATGGCGGGTCCCCGGTGGT (SEQ ID NO. 402)

TTTGCTGAAGANTGCTGAACCGTAGTCGAAGTGGGCGGCGTCAGACTCCACCCAGCCAGCAGGCAGCGCGAAGCTGAA

TCCTCCAACCGGGTTGTCGATCCGGACAGGTTGGGGTGCGTTTGGGGCAATGACAGGTGGCGGCGGTGCGTTCGGGTC

GGCCGGCGGAAGTGCTGCGTTGGGATCGCCCGGCTGGGCATTCGGCGTGTTGGCGGCGGCCGGTGG

Clone Rv315
::::::::::::Rv315SP6.seq::::::::::::
ACTCAAGCTTGAGATTGGCGTCAACGGGTGTCGGCACCGGCGTCCTGCAGTTGGTAGGCCTGCAGTTTGTGCATCAGC (SEQ ID NO. 403)

CCGATGCCGCGGCCCTCGTGGCCACGCATGTACANCACCACGCCGCGCCCCTCACGGGCGACCATCGCCAGCGCGGCG

TCCAGCTGAGGCCCGCAATCGCAGCGGCGTGACCCAAACACATCGCCGGTCAAGCACTCCGAATGCACCCGGACCAGC

ACGTCG

TCACCGTCGGCGTTGGGCCCGGCGATCTCGCCGCGGACCAGCGCGACATGTTCCACGTCCTCGTAAATGCTGGTGTAN

CCGATGGCGCGAAACTCCCCATGACAANTCGGAATCCCGCGCCTCGGCGACCCCGCTCAATGTTGCTTCTCNTGCTTG

::::::::::::Rv315T7.seq::::::::::::
TCGACNAGCATTCTTGACNGTTGTTTTGGCTCGGCATGGTTAGCCAAGGTTCTGCGGTCCCACCAGATCATCTTGGTC (SEQ ID NO. 404)

CGGTAGCGCTCGTCCGGGTATGCTGCCGCCGGGATTCTCGCTGCTATTACTCCCCCCGAAGAACGCCACCGGTCCAGC

GCGTGGGCCGCCGCGGTCCCCATCACAAACTGAACCCCCAACAGGGGACATGCTTAGCCGTAGGGCGCGCGCCAAGGC

GGCAGCAATCGCATCACTGCGCTGCGCGTCACTATTAACCCACCCGGACTTCACTTCCACGACCCCGAATGGCGCCCG

GTCATTGATCATCTTGCGCACCGCGGATAATCCGGGAT

TG

Clone Rv316
::::::::::::Rv316SP6.seq::::::::::::
ACCGGGGCCACTCCGCACAATCTGTACCCGACCAANATCTACACCATCGAATACGACGGCGTCGCCGACTTTCCGCGG (SEQ ID NO. 405)

TACCCGCTCAACTTTGTGTCNACCCTCAACGCCATTGCCGGCACCTACTACGTGCACTCCAACTACTTCATCCTGACG

CCGGACAAATTGACGCNGCGGTTCCGCTGACCAATACGGTCGGTCCCACNATGACCCANTACTACATCATTCGCCACG

GANAACCTGCCGCTGCTAAAGCCACTGCGATCGGTGCCGATCGTGGGGAACCCACTGGCGAACCTGGTTCAACCAAAC

TTGAAGGTNATTGTTNACCTGGGCTACGGCGANCCGGCCTNTGGTTATTCCACCTCNCCGCCCAATGTTTGCNACTCC

CGTTCGGGGTTGTTCCCNNAAGGTCAACCC

::::::::::::Rv316T7.seq::::::::::::
CGCTCAAGCGCNTGAGGCCGAANCGGCTGGTTACGACTCCCTGTTTGTGATGGACCACTTCTACCAACAGCCCATGTT (SEQ ID NO. 406)

GGGGACGCCCGACCAGCCGATGCTGGAGGCCTACACGGCCCTTGGTGCGCTGGCCACGGCGACCGAGCGGCTGCAACT

GGGCGCGTTGGTGACCGGCAATACCTACCGCAGCCCGACCCTGCTGGCAAAGATCATCACCACGCTCGACGTGGTTAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGCCGGTCGAGCGATCCTCGGCATTGGAGCCGGTTGGTTTGANCTGGAACACCGCCAGCTCGGCTTCGAGTTCGGCAC

TTTCAGTGACCGGTTC

Clone Rv317
::::::::::::Rv317SP6.seq::::::::::::
CTCAAGCTTGCGTTCGATGAAGTAGTCGTCGGTCAGCGCCGCCTCTTCGAGCTCCTTCGCGATGCCCAGCAAGGAGTC (SEQ ID NO. 407)

ATCGCCGCCGAGCTTGGCCAGGATCTTGTCGGCCTGTTCCTTGACGATGCGGGCCCGCGGATCGTAGTTCTTGTAGAC

ACGATGACCGAAACCCATCAATTTGACCCCGGCCTCGCGGTTCTTGACCTTGCGTACAAACTCGCTGACGTCGTGGCC

GCTGTCGCGAATGCCCTCGAGCATCTCCAGGACAGCCTGATTGGCGCCGCCATGAAGCGGACCCCATAGTGCGTTGAT

GCC

::::::::::::Rv317T7.seq::::::::::::
GGTCAGGCCGAGCAGGCGCGAGGAACGACGAACCCAACAAGCCATGGTGGTTGGCGCCGTCGAGAGGTCGGCGGTCGC (SEQ ID NO. 408)

CACAACGGGAAGATCGCCTTGAGCGTCGCTCGACCGCCGCCTCGAGTTGGGTCATAACGAAGTAGCTGATGCCGATCA

TGTCGACGTTTCCGTCGCATCAGCGTGCAGCGGCGACCCACTCNACGAGGTCTCGGTGCCGCCGCGGCCAGGGCACCA

GCAGTGACGAGTCCAGGCGCCGTCGGGCCAAGCAGTCGCGGTGCCANCCGTGGTGGGTCGGGCGATGGTTGGGTGTGC

TCATTTCGGGAACGCCA

Clone Rv318
::::::::::::Rv318SP6.seq::::::::::::
CTCGAAGCTTTAACAGCATCAACCCCGCCCCGCACCAGCACCGACACNATGTCGATGCCATCGAGGTGAATGTCGAAC (SEQ ID NO. 409)

TGGCGCAAACCATCGGCGACCGCGACCACCGGCAACATGGGTACCGGCGATTTCCGGTGCCAATGCCGACCCGACGGG

CCGCTCTCACCGCAGGTGACCTCGATCACCGAGACCANCCGGCCGTTNTNNTCACGCACCCCTACCGTGTCACGCCCA

AAACGGCGCTGGTGGTCGATTGCCGGAGTGCACCCCNCACCCAGTGTCGTGCCCGGATCC

::::::::::::Rv318T7.seq::::::::::::
TGATGCCGCACCCGATCGACGGTCGTTGGTCGGGGTTGACTGGCCGCCCGGCGAAGCAGGGCGTCGACCGCGGCCCGG (SEQ ID NO. 410)

ACGTCGGCGGCCGTCACCGGTCGGCCATTGCCCGGGCGGGAGTCGTCGAGCTGACCACGGTAGACAAGTCGGCGCTGG

CCGTCGAAGACNAACGTGTCGGGTGTGCAGGCCGCGGAGAAGGCGCGGGCGACNTCTTGGGTTTCGTCGTANAGATAC

GGGAACGTCCAGCCGTGGCGGCGGGCCTCGGCGACCATCTGATCGGGCCCGTCC

Clone Rv319
::::::::::::Rv319SP6.seq::::::::::::
TTTCGGGCGAGGCGGTATANCTTCCCNTCGTACCGGCGACCGCCAGCCGANAAGCTCGTTTTCCCAGTGTTGCTGGGG (SEQ ID NO. 411)

ATTCTCACGCTGCTGCTGANTGCGTGCCAAACCGCTTCCGCTTCGGGTTACAACGAGCCGCGGGGCTACNATCGTGCG

ACGCTGAAGTTGGTGTTCTCCATGGACTTGGGGATGTGCCTGAACCGGTTCACCTACNACTCCAAGCTGGCGCCGTCT

CGTCCGCAGGTCGTTGCTTGCGATAGCCGGGAGGCCCGGATCCGCAATGACGGATTCCNTGCCANCGCTCCGAGTTGC

NTGCGGATCGACTACNAATTGATCACCCANAACCATCGGGCGTNTTACTGCCTGAAGTACCTGGTGCGGGTCGGATAC

TGCTATCCGGCGGTGACAACCCCGGCAAGC

::::::::::::Rv319T7.seq::::::::::::
GTTTTGGCTCGGCATGGTTAGCCAAGGTTCTGCGGTCCCACCAGATCATCTTGGTCCGGTAGCGCTCGTCCGGGTATG (SEQ ID NO. 412)

CTGCCGCCGGGATTCTCGCTGCTATTACTCCCCCCGAAGAACGCCACCGGTCCAGCGCGTGGGCCGCCGCGGTCCCCA

TCACAAACTGAACCCCCAACAGGGACATGCTTAGCGGTAGGGCGCGCGCCAAGGCGGCAGCAATCGCATCACTGCGCT

GCGCGTCACTATTAACCCACCCGGACTTCACTTCCACGACCCCGAATGGCGCCCGGTCATTGATCATCTTGCGCACCG

CGGATAATCCGGGATTGCCAGCCCATTCNACTACCGCATGCGAGTCATCGGCTGACCGCAGCGGTC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv31
::::::::::::Rv31SP6.seq::::::::::::
TCGCCTAGGCGGGCTTCCCCTTCCGTCCGAGCNGTCAGAAGCTCCTATGACAATGCACTACCCGAGACNATCAACGGC (SEQ ID NO. 413)

CTATGCAATACCNAGCTGATCAAACCCGGCAAGCCCTGGCGGTCCATCGAGGATGTCGAGTTGGCCACCGCGCGCTGG

GTCGACTGGTTCAACCATCGCCGCCTCTACCGGTACTGCGGCGACATCCCGCCGGTCTAACTCGACGCCGCCTCACTA

CGCTCAACGCCAGAGACCANCCGCCGGCTGACGTCTCAGATCAGAGAGTCTCCGGACTCACCGGGGCGGTTCATCCCC

ACTGTCGATAGCGTCTGTGGATAACTTTGTCTGCA

::::::::::::Rv31T7.seq::::::::::::
GCGCGTNGAACTGATAGGTGCGGCCCGGCTCGAGCANGCCGGCCATTTGTTCGATGCGGTTACCGAAGATCTCTTCGG (SEQ ID NO. 414)

TGACCTGCCCGCCGCCGGCCAGCTCGGCCCAGTGCCCGGCGTTGGCCGCCGCGGCGACAATCTTGGCGTCCACGGTGG

TCTGGGTCA

Clone Rv321
::::::::::::Rv321SP6.seq::::::::::::
CTCAAGCTTCAATACAGAGTTATAAACTGTGATAATCAACCCTCATCAATGATGACNAACTAACCCCCGATATCAGGT (SEQ ID NO. 415)

CACATGACGAAGGGAAAGAGAAGGAAATCAACTGTGACAAACTGCCCTCAAATTTGGCTTCCTTAAAAATTACAGTTC

AAAAAGTATGAGAAAATCCATGCAGGCTGAAGGAAACAGCAATAACTGTGACAAATTACCCTCAGTAGGTCAGAACAA

ATGTGACGAACCACCCTCAAATCTGTGACAGATAACCCTCAGACTATCCTGTCGTCATGGAAGTGATATCGCGGAAGG

AAAAT

Clone Rv322
::::::::::::Rv322SP6.seq::::::::::::
CTCAAGCTTCGATCGACATTACTCCCGCCTTGGGTCTGGTCTCCGAGCTGGTCGGTCATGGTCGGACCTGCTGGTAGT (SEQ ID NO. 416)

GGGGATCTAACGCAACATGGTCGGGATTCATCATGGTGTACCCGTGATACCCATTCGCAGCTGCCGGTGAAACCCCGC

GATGCCGGGATTTCCAGCCGCACTAGGATGTCTAGCCGGCCAGCCGCTGCCGCCGGACTTCGGGATGTTCGGTATACC

ANCGATCGGCAATCTTGCGTATCCGCCGATGCTCGAACGCTANCCACGCCAAACCAACCACTGTGACNACAATCGCCA

CCACACCAAAGGTCATGCCCTCGGCGTGATGTCCGGTGCCGAAAGCCGCAAGAGCTCCGACGCCGCC

::::::::::::Rv322T7.seq::::::::::::
CATTCCCAATTGAATTTCCCNATCCCACAATCTCGGTTCAGATACAGGTCGCCATACCCCTTACTTCGGCAACGCTGG (SEQ ID NO. 417)

GCGGATTGGCCCTGCCGCTGCAGCANACCATCGACGCCATCGAATTGCCGGCAATCTCGTTCAGCCAATCCATACCCA

TCGACATTCCGCCGATCGACATCCCGGCCTCCACTATCAACGGAATTTCGATGTCGGAGGTCGTGCCGATCGATGTGT

CCGTCGACATTCCGGCGGTCACCATCACCGGCACCAGGATCGACCCGATTCCGCTGAACTTCGACGTTCTCAGCAGCG

CCGGACCCATCAACATCTCGATCATCGACATTCCGGCGCTGCCGGGCTTTGGCAACTCGACCGAGCTGCCGTCGTCGG

GCTTCTTCAACACCGGCGGCGGTGGCGGCT

Clone Rv327
::::::::::::Rv327SP6.seq::::::::::::
CTCAAGCTTTCGGCGGAGACGGACANNTTGCGAACATTGATGACAAAATAGAAATCATTGATGGTTTGAGTCACCAGG (SEQ ID NO. 418)

CCGATCAAGCCTTCGCCGAGCCAAATTCCAATCAAGAGGCCCAAGCCCGTACCAATCAGCCCGGCAACGAGGGATTCC

GTCATTATCAGCCAAAATAACTGCTCTCGGGTTACACCCAAACAGCGCAATATGGCGAAAAACGGTCGCCGTTGCACG

ACATTAAATGTCACGGTATTG

::::::::::::Rv327T7.seq::::::::::::
AGCTTAACTGCTCCCTAATACCTGGGGCTGTGCCTGCGGTGTATGCACGGCATACGGACATCCNTCCCCTGAGACCCN (SEQ ID NO. 419)

CGGTCTAATCAGCCACGTGTCCACCATCAGGGGTCAACCCCGGCCAAGGGCGACGGCACCCCAAGTTCGCCGACCGTT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

AACCTATTGCTGTGAGCTTCATTTGCTGCGAGCAAAACAGTTGGTCGGCCGTTAGGAACTGAATTGACACTCAACCGA

TTTGGTGCCNCCGTAGGTGTCCTGGCTGCGGGTGCGCTGGTGTTGTCCGCGTGTGGTAACGACCACAATGTGACCGGG

GGAGGTGCAACCACTGGCCACGCGTCCGCGAATGTCTATTGCGGGGG

Clone Rv328
::::::::::::Rv328SP6.seq::::::::::::
CTCAAGCTTGGGGTGGCGCTGTCGGTCGGTGTGCTTGGCGGCGTCGGTATCAACACCGCCCACGAAATGGGGCACAAG (SEQ ID NO. 420)

AAGGATTCGCTGGAGCGGTGGCTGTCCAAAATCACCCTCGCCCAGACCTGCTACGGGCACTTCTACATCGAGCACAAC

CGTGGCCATCACGTCCGGGTGTCCACACCGGAGGACCCGGCGTCGGCGCGGTTCGGCGAAACGTTGTGGGAGTTCCTG

CCCCGCAGTGTTATCGGCGGCTTGCGCTCGGCCGTTCATTTGGAGGCCCAACGGCTGCGTCGGCTCGGCGTCAGCCCC

CT

::::::::::::Rv328T7.seq::::::::::::
GCACCAAGGCCCCACACGTCACCCTGTGACCTCCTGCGCCGACCCCGCCCGAGGTCCTGGCCGTTACCACCTGAACGG (SEQ ID NO. 421)

GCGAGCCGGGAGTCTGGTACGCATCGAACAAAGAGCAAGGTGCATGGGCGGAGTTGTTCCGCCACTTCGTCGATGACG

GGGTCNATCCATTCGAGGTCCGTCGCCGCGTCGGTCGAGTGGCGGTCACACTCCAGGTACTCGACCTCACAGACGAGA

GGACTCGATCCCATCTAGGTGTGGACGAAACAGATCTTCTGTCCGA

Clone Rv329
::::::::::::Rv329SP6.seq::::::::::::
TCGCCTCCGCATATGGGTCGACGCCAAGCGGGTCCGGATTTCTGGGCTTCATCGCTCGCGCCGTCGCGACAAACAGCG (SEQ ID NO. 422)

CGGTCGAACCGACACTCGTTGTGATGTCCCAGCTATCACCTTCGGTACGCACCCAATCGACCCTACNCGGCTATCTCA

GCCGCGATCTCCAGGCTCCGCCGAGCCAGGTGCATCCCGGTCCGGATCCCACTAACCCGGCACCATTGGCGTCN

::::::::::::Rv329T7.seq::::::::::::
GTCCTCGAGTGCCGCCGTCGNCACNCCCAGCGCCCGCGCGGCCACTTGGATGCGACCCGTTTCAAGTCCCTTCATCAT (SEQ ID NO. 423)

CTGCGAAAAGCCTTGACCCATGGCTCCGCCCAGGATCCCCGAGACCGGCACCCGGAGGTTGTCGAACGACAGCTCGCA

GGATTCGACGCCCTTGTAACCCAACTTCGGCAAGTCCCGCGACACCGTGAGTCCCGGCCCGGGTTCGACGAGCACGAT

CGACATGCCTTGGTGCCGCGGTGTGGCGTTCGGGTCGG

Clone Rv32
::::::::::::Rv32SP6.seq::::::::::::
GGCATACCAATGTGGACTTCTGCTCACCCACGATATCCGTGGTCTGATCCGCTGCTGCGGCGGGCTGCNACCTGCNTC (SEQ ID NO. 424)

TCNGCGGCACCCGTNACTACATGGCNCGCGCCGCACGCATACGTCGCGGCGGGACCCACTCCNACTGGTCGACGGTGC

TGGCCGCGTGTCCGCANGTCCCNAACCCGGCCGCACCGACGAAACCGGCCGCCGTCCGTTCTGGACCAACGCTCATGT

GCCGTCGGGGTCCATGCTCGACGCCATCGAGACCGTAACCAGCGTCCTCGAGCGGTTCGCCTCCGGCTTCCGTGACAT

CTTCGTGGCTGCTCGCGCCGTGCCGCCGCGCGGATGGTCGACCACAACGCCAACCACCTCGGCGGTGACATCACCGTC

CGCGCCACTCGACCTGGCGCGCGATCGCGGCCC

::::::::::::Rv32T7.seq::::::::::::
GTGAGCAGACCTACGCCNCCTGGTTGCGCCAACTCGGTACCGATCATGGCGCGCNGCCTGTCGTCACCGATACCCAGC (SEQ ID NO. 425)

GAACAAGACAGCCCGGTCCGCGACAAGATGACTTTCCCGATCTCTTCGGCGACTTCCATGGGGTCGTCCGGAGTCCCG

GGCGCCACCGCGAGGTAACCCTCGTCTCAGTCCCATACGCGACCGGGTATCCACGTCGCGCAACAACGCCACCACCTC

CCCAGACGCCNCGTTGTACGCGGCTGGGTTCCACNGCAATAAGTGGCCTCANGGCATCGTCCGGCGGCGGTCCNCAAC

GCA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv330
::::::::::::Rv330SP6.seq::::::::::::
CTCAAGCTTGAGGTTAACTTTGAACGGATCGAGCTGGACGTTCGAGACGGTGATCGGGCCGAACCTGAATTGTCCGGT (SEQ ID NO. 426)

AATGCCCAACGCAAAAAGCAGGGTGGTGGCCGGGGCGGTGAAACCGGCGTCGGCGGCACCGTCGAAATCTATGTGGAT

TGCCGGAATGGGGATGTCCGGCACGGCGAAACCGTAGTTCGCTTGTCCCGTGAGGCCCACGTGGATGGGGGGAAAGAT

CCTGGTGTCCGGGATAATAATGGGGCCGATGCCGCCGGTTGAAGTCCACTGGATCGGGAATTCCGGAATCTTGATCCG

ACGTTCAGGCCGAACAGGCCCTC

::::::::::::Rv330T7.seq::::::::::::
CGGCGACGTCGCGATACGCCGAGCAGTTGGGAATCGCTCTGCAGCAAACCAATATTCTGCGCGACGTTCGAGAGGACT (SEQ ID NO. 427)

TTTTGAATGGACGGATCTACCTGCCGCGCGACGAGCTGGACCGATTAGGCGTACGCCTCCGCCTGGACGACACCGGGG

CACTCGATGACCCCGACGGACGGCTCGCGGCNCTGCTGCGGTTCAGTGCCGACCGCGCCGCAGACTGGTNTTCGCTGG

GACTGCGGCTGATTCCACACCTCGACCGCCGCAGCGCTGCCTGCTGTGCGGCCATGTCTGGCATCTACCGCCGTCAGC

TCGCCTTGATCAGAGCATCGCCGGCGGTCGTCTA

Clone Rv331
::::::::::::Rv331SP6.seq::::::::::::
CTATAAAATACTCAAGCTTGATGCCGCCGAAACCGAGCGTGAGCACGCCGCCAGCCACCACGCGCGGGTCGGGCGCCG (SEQ ID NO. 428)

GGCCCGGGCCGCCAGGCTGCTCCGCTCGGTGATGGCACGCCACCGCGACACCACCCGGNTGCGCTACGTCNAGCCATA

CCGGGCGGAGCTACATCGGCTCGGCCGCCCAGTGTTCGGGCCCTCTTTCGAGGTCNAGGTCNATACCGATTTGCGCAT

CCGCAGCCGCACCCTGAACNACANAACCGTGCCCTACTATTGCTTGTCNGGCGGGGCCAAAAAACAGCTTGGCATCCT

GGCCCNATTGGCCGGCGCGG

::::::::::::Rv331T7.seq::::::::::::
CTTCGGTCGCAGTGTGCGAGTGATAGATGACGACCGGGACCTGCTCGGCATCTTCCATAGCCCGCCACACCTTCAGTT (SEQ ID NO. 429)

GCTCACCGGAATCCAACCGGTAGAAGGTCGGCGAGCGCTCGGCATTGGTCATCGGGATATGCCGCTCGGGACGGTCAG

AGCCCTCGGGTCCGGCCAGCACTCCGCAGGCTTCGTCGGGGTGGTCGCGACGCGCATGGGCCACCATCGCATTCACCA

GGTCTGCGCGAATCNCCANCACGTANACNGTTCCTTTCCTAA

Clone Rv333
::::::::::::Rv333SP6.seq::::::::::::
CTGGCACCAAGGCCCCACACGTCACCCTGTGACCTCCTGCGCCGACCCCGCCCGAGGTCCTGGCCGTTACCACCGAAC (SEQ ID NO. 430)

GGGCGAGCCGGGAGTCTGGTNCGCATCGAACAAANAGCAAGGTGCATGGGCGGAGTTGTTCCGCCACTTCGTCGATGA

CGGGGTCNATCCATTCGAGGTCCGTCGCCGCGTCGGTCNAGTGGCGCTCACACTCCAGGTACTCGACCTCACAGACNA

AAGGACTCNATCCCATCTAGGTGTGGACNAAACAGATCTTCTGTCCGACNACTACACCACCACCCAGGCCATCGCCGC

CGCCCGCGATGCCAACTTCGACGCCGTACTGGCCCCGGCGGGGGGCGCTCCCCGGTTGTCAACACTTGCCGTGTTCNT

TCACGCNCTGCCCCACATCCAACCCCAACG

Clone Rv334
::::::::::::Rv334T7.seq::::::::::::
GTTCTTGGGCCCATGCGGAGGTATCGCCGTTTCCACCACGCGGTCGGGGTGGCGTTGCATTAGCTCACCGATGGTGCG (SEQ ID NO. 431)

CTTGTGCAGGCCGCCGGGATACCCCGAGTGCCGGTAAACCATCTTGTGCTGC

TABLE 3-continued

| End-sequences of the polynucleotide inserts cloned in the named recombinant BAC vectors contained in the I-1945 *M. tuberculosis* H37Rv genomic DNA library. RvXXXSP6 corresponds to the SP6 end-sequence of the clone RvXXX. RvXXXT7 corresponds to the T7 end-sequence of the clone RvXXX. RvXXXIS 1081 corresponds to a region located close to a copy of the IS1081 repetitive sequence (Insertion element). The character << - >> denotes an uncertain base residue. |
|---|

Clone Rv335
::::::::::::Rv335SP6.seq::::::::::::
CAATACTCAAGCTTGGCGTGCCGTTCCAACCCGAATTGGCTTTCGGCGCCATCGGTGAGGACGGCGTGCGGGTGCTCA (SEQ ID NO. 432)

ACNACNACGTCGTCCGCGGGACACACCTCGATGCTGCCGCCATGGACGCGGTCGAACGCAAGCAGCTGATCGAAGTAC

AACGCCGCGCGGAACGCTTCCGCCGCGGGCGTGACCGCATCCCGTTGACCGGGCGGATC

::::::::::::Rv335T7.seq::::::::::::
CNTCATGATGATCATCACCCGAAGTGTGGTAGCCGCAGTGGTTATCGTGGGTACCGTCGTGCTTTCCATGGGCGCCTC (SEQ ID NO. 433)

TTTCGGGCTTTCCGTATTGGTCTGGCAGGACATTCTGGGTATCGAGTTGTACTGGATGGTGTTGGCGATGTCGGTGAT

CCTGCTCCTGGCGGTGGGATCCGACTACAATCTGCTGCTGATTTCCCGGTTGAAAGAGGAAATTGGGGCCGGATTGAA

CACCGGAATTATCCGTGCCATGGCTGGTACCGGGGGAGTGGTGACGGCTGCCGGCATGGTGTTCGCCGTTACCATGTC

GTTGTTTGTCTTCACCCATTTGCGAATTATTGGTCAGATCGGTACCAC

Clone Rv336
::::::::::::Rv336SP6.seq::::::::::::
ATACTCAAGCTTTTACGGTGATCGCNCATCACCTGGTTCATGAACTGGAAGCAGCGCAGCGCTTCCTTTTCGGCCGCA (SEQ ID NO. 434)

ACATGAGCCAGCCTCTCGTCGGCGGTCGGGTGCAGGTGCTCGGGCAGCTCGGCCGCNACAGCCGCCTGACCCTGAAAC

CAGCTTCCATATCCCGCGANNAACGACGCCAGTCCGCTACGTNACCCCTCCGCGACTCTCCATGGACAACAGCCCCTT

CTCCACCGACCGGGCCCGGGTGTGGGGTNTT

::::::::::::Rv336T7.seq::::::::::::
GCTGGTAGAGTCGCTGACCGGTGCAGGTTTCGACAATGTGGTGCCGGTTCGGCGGCTACGTGCCATCGAGACACTGGC (SEQ ID NO. 435)

GCAGGCTATCGCACCCGTTATCGGCTACGAGCAAATCGCGGTATGCGTTCTTGAGCATGAGTCGGCGACCGTCGTCAT

GGTCGACACCCACGACGGAAAGACGCAGATCGCCGTCAAGCATGTGTGCCGCGGATTATCAGGACTGACCTCCTGGCT

GACCGGCATGTTTGGTCGCGATGCCTGGCG

Clone Rv337
::::::::::::Rv337SP6.seq::::::::::::
GCTTTCCGCCGATACCCGCCATGTCNCGCACATCCAGGACTTCTGGGGGGATCCGCTGACAGCGGCGGGATCCCAAAG (SEQ ID NO. 436)

TGCGGATGATCGGGCCGCCTACGTCGTGGTGTACCTCGTCGGTAACAACGAAACCGAAGCGTATGACTCGGTCCACGC

GGTGCGGCACATGGTGGACACCACACCGCCACCGCACGGGGTGAAGGCCTATGTCACCGGTCCGGCANCACTCAATGC

CGACCAGGCCGAGGCCGGANACAAAANTATCGCTAAGGTCACCGCGATCACNAGCATGGTGATCGCAGCAATGTTGCT

AGTGATCTATCGCTCCGTAATTA

::::::::::::Rv337T7.seq::::::::::::
CTTCCAACCCGAATTGGCTTTCGGCGCCATCGGTGAGGACGGCGTGCGGGTGCTCAACGACGACGTCGTCCGCGGGAC (SEQ ID NO. 437)

ACACCTCGATGCTGCCGCCATGGACGCGGTCGAACGCAAGCAGCTGATCGAGCTACAACGCCGCGCGGAACGCTTCCG

CCGCGGGCGTGACCGCATCCCGTTGACCGGGCGGATCGCGGTGATCGTCGATGACGGCATCGCCACCGGAGCGACGGC

CAAGGCGGCGTGCCANGTCGCCCGGGCGCACGGTGCGGACAAGGTGGTGCTGGCGGTCCCGATCGGCCCA

Clone Rv338
::::::::::::Rv338SP6.seq::::::::::::
TACTCAAGCTTCGCGAGATCCGGATGGCACTCACGCTGGACAAGACCTTCACAAAATCTGAAATCCTGACCCGATACT (SEQ ID NO. 438)

TGAACCTGGTCTCGTTCGGCAATAACTCGTTCGGCGTGCAGGACGCGGCGCAAACGTNCTTCGGCATCAACGCGTCCG

ANCTGAATTGGCAGCAAGCGGCGCTGCTGGCCGGCATGGTGCAATCNACCAGCACGCTCAACCCGTA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv338T7.seq::::::::::::
CCCACGACTTTCTCCTCGATCACTTGGATTTGTACGAAGAGGCAACGAAAGCAGTGATCCTCGGGATGGTCGACGCCT (SEQ ID NO. 439)

ACATCGACCCGCCGTTCACGCCGCACAGCCTGCTAGATGCGCTGGGCGAGCAGGTCCCACAGTTCGCCGCTAAGGCAC

GGCGTCTGTTCCCGTCCGGATCGCCATTCGGCCTCGGCGTCCTGCTCCCATTCGATCAATAGGGCTGGCAGCTCCGTC

GGCAGGGGCCTACGCCTCACCCCGTCACG

Clone Rv339
::::::::::::Rv339SP6.seq::::::::::::
CTCAAGCTTATGCGCGCCGGCCGAGGTCTGCTCACGGCAACCCCTGAAGTTTAGGGGACNACCTACTCAGCGCAAAAT (SEQ ID NO. 440)

TTCGCTAATGTGAGTCCGCCCCACCAGGGGNANATCAACCCATGTCGATCATGATCTACCCGGATACCGGATTGGCGG

TAGCGCCCACGATCGTCNAAATNTCCGCCTGAATCATCGGATAGCTGATCCGGCGTCAACGCGTTTTGANTTCACCGC

GCAACAGCCGCCAGGCCGGCCCGCANCGANCCGATCTCNTCGGGCCGCATGGGCCCCAATCTTNTCG

::::::::::::Rv339T7.seq::::::::::::
GTGTGTGGTGGAACCCATCTGAGCAGTGTGCCAAACCGGGGCAGACAGCTCCCAATTGACGTGAGCCCGCTCACTTGC (SEQ ID NO. 441)

TGGGTAAGCGTC

Clone Rv33
::::::::::::Rv33SP6.seq::::::::::::
CTTTACACTTCCTGCATCCGGCTCGTATGTTGTGTGGAATTGTGAGCGGATAACAATTTCACACAGGAAACAGCTATG (SEQ ID NO. 442)

ACCATGATTACGCCAAGCTATTTAGGTGACACTATAGAATACTCAAGCTTGGGCGTGACGGCCACCGGGGCCACTCCG

CACCATCTGTACCCGACCAAGATCTAC

::::::::::::Rv33T7.seq::::::::::::
CAGGCATGCAAGCTTTAGCTGCCCGAATGCGTCACCCCGATGCGCCCAGATCGGGGCTTCGCACATAAAGCACGAACA (SEQ ID NO. 443)

GGCGGGCAAAACGTCNATCTCGGAGCCGGAAGGGCAATCAGCCGACCGTCGACGAACGACACCGGCGAGACCACTTAG

GCAGTGACGGCCGGCCCGAACATTACGCGCTCGTTGATTAGGCGTTCGGTCTCGTCCGCGGTCATGCCGAGCAGCTTG

CGGCAGATCTGAACGCTGTCCTGTCCGGGCAGCGGCGCCGGGCGTTGGGGTGCCTGCCCGAATGTGACGAAACGGAGC

CGGACCCGTCTCGGCGGGCCGCGGACGGCGATCCGC

Clone Rv340
::::::::::::Rv340SP6.seq::::::::::::
CNCAAGCTTGCGGATGTTACCCCTGACAGCCTGAACTATGTCNAAACACACGGCACCGGAACGTTGTTGGGGGACCCC (SEQ ID NO. 444)

ATCGANTTCGAGTCGCTGGCGGCCACTTATGGCCTGGGTAAAGGCCAGGGCNANAGCCCGTGCGCATTGGGGTCGGTC

AAAACCAACATCGGCCACCTGGAGGCGGCCGCCGGTGTGGCTGGATNCATCAAGGCGGTGCTGGCGGTGCAACGTGGG

CACATTCCCCGCAACTTGCACTTCACCCGGTGGAACCCGGCCATCNACGCGTCGGCNACGCGGCTGTTCGTGCCNACC

NAAAACCCCCCGTGGCCGGCGGC

::::::::::::Rv340T7.seq::::::::::::
GGAACCGGTAACCAGATCAGCTCGTCGACCTCACTGCCGGGGGTGAATTCCCCACCGGTGCTGCGCGCTGCCCAGTAG (SEQ ID NO. 445)

TGCACCTTCTTGACGCCTCGAAAAGGGGAGTCGGTCGGGTAGGTCACCGTCAGGAGCCGCCTACCCAGGTTGGCGCNA

TAGCCGGTCTCCTCGAGTATCTCCCGCACCGCCCCCACCGGTGCGGTCTCACCCANATCCACTTTGCCCTTGGGCAGC

GACCAGTCGTCGTANCNGGGGCGGTGAATGACAACGATCTCGACCGGCCCTTCCN

Clone Rv341
::::::::::::Rv341SP6.seq::::::::::::
TACTCAAGCTTCAGAACAGGCCTGTTGTGGGCNCACCCGGCTCGCCGAGTTCTGCACCCACCGCCTCAAGTGCGGCCC (SEQ ID NO. 446)

GCACCGCCGGCATCTCCCGGTCACGCAGGGCCGCGGCCCGCGCCGCAGCGACGGCGTGTTCGCGCAGTTCGCCGTCAA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TGATGCTGACCTGATCGGCCACCCGGGCGTTCTCGGCGTCGTCGCGTTCACTAATCGCGGTGCTCAGCAGCGTCTCGA

CAGCCACCACCCGAGTGGCGACCAGCTGC

::::::::::::Rv341T7.seq::::::::::::
TAATGTCTTGCCGACGTCACCACAATCGCGATGAATTCAATCATGCCGCCCAGGGCGGCCAACCCAATGGTGGCCGCG (SEQ ID NO. 447)

AGCGGCAGCTCGATCGCAGCGCGGAGGTTGCCGGCCGCCAGTTGATTCACGAACAGGGTGAGGTCATAGGCGGGCAGG

ATAGTGACGAAGGCAAGACCTATATCTGCCGTCGGAAGAAGAATCGAGTAGCCGGTCGACACAACGGAAGCGAAAGTG

TCCGCGATGTTGATGAGCGTCGCCGGTTGTGGCGGCGGTGGCGGC

Clone Rv343
::::::::::::Rv343SP6.seq::::::::::::
TACTCAAGCTTTCGTCAGTTCATCGCGCCAGCAGACCAACAAGAGCATCGGGACATACGGAGTCAACTACCCGGCCAA (SEQ ID NO. 446)

CGGTGATTTCTTGGCCGCCGCTGACGGCGCGAACGACGCCAGCGACCACATTCAGCANATGGCCAGCGCGTGCCGGGC

CACGAGGTTGGTGCTCGGCGGCTACTCCCAGGGTGCGGCCGTGATCGACATCGTCACCGCCGCACCACTGCCCGGCCT

CGGGTTCACGCAGCCGTTGCCGCCCGCAGCGGANNATCACATCGCCGCGATCGCCCTGTTC

::::::::::::Rv343T7.seq::::::::::::
CCACCCGTGTAATTTGGGATGGGCNAAAAGGCNAACCACCGCGTGGCCACGAACGCCGGGAGGGACAATCTCGGGCGG (SEQ ID NO. 449)

CTAGGGCTTCTCGCGGGAAGGCCCGAACGTACGGCGTTTCAACACGTCGCCTCGCCCTCGGACCGCGAACATTCGGGG

ATGGCAGCAACCTGGTAGCACCCTGGCCGGGCGATGATCTGCAGCGTCGCCGCGGGTAGTCGCCGCCCGGGCGGCTAC

AGTCTGAAACGCGATGACCATCGATGTGTGGATGCAGCATCCGACG

Clone Rv344
::::::::::::Rv344SP6.seq::::::::::::
TCAAGCTTTAGCTGCCCGAATCCGTCANCCCGATGCNCCCAGATCGGGGCTTCGCANATAAAGCACNAACAGGCGGGC (SEQ ID NO. 450)

AAAACGTCNATCTCGGAGCCGGAAGGGCAATCANCCGACCGTCNACAAACGACACCGGCGANACCACTTAGGCAGTGA

CGGCCGGCCCGAACATTACNCGCTCGTTGATTAGGCGTTCGGTCTCGTCCGCGGTCATGCCGAGCAGCTTGCGGCANA

TCTGAACGCTGTCCTGTCCGGGCAGCGGCGCCGGGCGTTGGGGTGCCTGCGGAATGTGACNAAACGGAGCCGGACCCN

TCTCGGCG

::::::::::::Rv344T7.seq::::::::::::
CCGGGGCCACTCCGCACAATCNGTACCNNACCAANATCTACACCATCGAATACGACGGCGTCGCCGANTTTCCGCGGT (SEQ ID NO. 451)

ACCCGCTCAACTTTGTGTCGACCCTCAACGCCATTGCCGGCACCTACTACGTGCACTCCAACTACTTCATCCTGACGC

CGGAACAAATNGACGCNTCGGTTCCGCTGACCAATACGGTCGGTCCC

Clone Rv346
::::::::::::Rv346SP6.seq::::::::::::
NCTGGCCTTTGGTCCACACTAANACAATACTCAAGCTTCCGGCCGCAGAGCCGCCAACTCACGATATCGTTAACCGAT (SEQ ID NO. 452)

ATCCCGAGCCGATAGCTGGCGGGCTCGGGTGGTGGCCAGCGGCGCTGCGACNAAAGGTGTGACCGTCATGAAACAGAC

ACCACCGGCGGCCGTCGGCCGTCGTCACCTGCTCGANATCTCAGCATCCGCAGCCGGTGTGATCGCGCTTTCGGCGTG

TNGTGGGTCNCCGCCCGAGCCCGGCAAAGGCCGGCCCGACACAACCCCGGAAC

::::::::::::Rv346T7.seq::::::::::::
CATCTGCCCACCACACGGACCGCGGTGCGGACGCGGCTGACGCGCCTGGTGGTCAGCATCGTGGCCGGTCTGCTGTTG (SEQ ID NO. 453)

TATGCCAGCTTCCCGCCGCGCAACTGCTGGTGGGCGGCGGTGGTTGCGCTCGCATTGCTGGCCTGGGTGCTGACCCAC

CGCGCGACGACACCGGTGGGTGGGCTGGGCTACGGCCTGCTATTCGGCCTGGTGTTCTACGTCTCGTTGTTGCCGTGG

ATCGGCGAGCTGGTGGGCCCCGGGCCCTGGTTGGCACT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv347
::::::::::::Rv347SP6.seq::::::::::::
GACAATACTCAAGCTTGACTGGCCACCCACCGGCATGACCACCGACAGGCCCGACTGGTCGTACCACTCGAACGCCGG (SEQ ID NO. 454)

GGTGTTGATGTCCCAGCCGCTGAANTCGTCCTGCGCGCGCAGGCCGTCNAACAGGTACAGGGCGGGCGAATTGGCACC

ACCACTTTGGAATTGGACCTTGATGTCACGGCCCATCGACGGCGACGGCACCTGCAGGTACTCCACCGGCAAGCCCGC

CCGGGAAAATGCCCCCGCGGTCNCCGTGCCACCGACGGCGCCCANCAAACCCGACACTAGGGCCGCGCCNACGGCCCC

GACCACNANTCNACGCGACATACCCGTGACGGCGCCACNAACCCTGTCAACA

::::::::::::Rv347T7.seq::::::::::::
CCTCCAACTCGGCGGGGAAGCGACNCCAGCCTACCGAGCTTGGAGTCCANGACGCCAGCGGCGGCGTCGGTCTGCGTC (SEQ ID NO. 455)

GTGGTGCCGCCGGGGTGGCGTTGGCTGGCAACGATCTCCACCCAGCCGGTCGGGTTACCCACGATCTCGGCATANACG

CGGGCCGAGGCCGGTGCGATACCGTATTGCGTCAATTGGGACGCGGTTGTGCATTCGGCTAGCTCGGTTGCCACACCC

GTCAGGGGTTCGACGTTGGCGGGTTCGGCGGGCCCCANCACCGCTGTCACCATGCCCGCCAAGCCGACCTGCGGCGCC

ACCAACTGCAGCACCANCATGTCGCCGTCGCGCGCCGCGATCACATGG

Clone Rv348
::::::::::::Rv348SP6.seq::::::::::::
CTCAAGCTTTTTGAGCGTCGCGCGGGGCANCTTCGCCGGCAATTCTACTANCGAGAANTCTGGCCCGATACGGATCTG (SEQ ID NO. 456)

ACCGAANTCGCTGCGGTGCANCCCACCCTCATTGGCGATGGCGCCGACNATGGCGCCTGGACCGATCTTGTGCCGCTT

GCCGACGGCGACGCGGTAGGTGGTCAAGTCCGGTCTACGCTTGGGCCTTTGCGGACGGTCCCGACGCTGGTCGCGGTT

GCGCCGCNAAAGCGGCGGGTCGGGTGCCATCAGGAATGCCTCNCCGCCGCGGCACTGCACCGCCAGTGCCGCGGCGA

::::::::::::Rv348T7.seq::::::::::::
CNCCAGCTTGATTGGTCTGGTTGCATTGGCCAGCTGCGCGAGCCTGGCTCACTTCAACTACGACGACCGCAAACAATT (SEQ ID NO. 457)

GCCGCCTTCGGATCCGAGTTCGGTTGGGTACGCGGCAATGGAGCACCATTTCTCGGTGAATCAGACTATTCCTGAGTA

CTTGATCATCCACTCTGCACACGACCTGCGAACCCCGCGCGGCCTTGCCGACCTGGAGCAGCTGGCGCAACGTGTGAG

CCAGATCCCAGGCGTTGCCATGGTTCGCGGTGTGACCCGGCCAAACGGGGAAAC

Clone Rv349
::::::::::::Rv349SP6.seq::::::::::::
CAATACTCAAGCTTGACTGGGCCCGCACCTTCGGCGCCACCCACACCGTCAACGCCCGCGAAGTCNACGTCGTCCAGG (SEQ ID NO. 458)

CCATCGGCGGCCTCACGGATGGATTCGGCGCGGACGTGGTGATCGACGCCGTCGGCCGACCGGAAACCTACCAGCAGG

CCTTCTACGCCCGCGATCTCGCCGGAACCGTTGTGCTGGTGGGTGTTCCNACGCCCGACATGCGCCTGGACATGCCGC

TGGTCNACTTCTTCTCTCACGG

::::::::::::Rv349T7.seq::::::::::::
TCGACGGTTTGGCGGCCTTAAATGCACTGAGGTCGTCAATTGACCCCACAGCGGAAATGCCGACTATTCGCAGGCCTC (SEQ ID NO. 459)

CTTCGCCTTGGCTGCCGGAGAGGGGCTCCGCGGGAACCGCATGCAGGTATATGACCTCGGTTTCTCGGGTGCTACCGC

GTGCCTTGTNTANGATNANCTCGGCGTTGGAATTGTCCAGCCGGCCCAATTCATCGAGCGCANATTCGTACACNTGGC

CGGCGGCGACATACGCTTCACCGTGGATCTGCTCCACACGGACCGCCCTGTCGGGATCCTGCTCACGGGTAANGGAAC

TTACGTGGCACTCGG

Clone Rv34
::::::::::::Rv34SP6.seq::::::::::::
GACCACGCCAGGCTAATCACGTGACGCTACCGAATACCCTNCCTAGTGGTGCAGGCTCCCGCTGGAAATGGCCCTGTA (SEQ ID. NO. 460)

CCAACTCGCGCACCGGTGCCAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv34T7.seq::::::::::::
CGGCACCCGACCCCTTTGAGCCGTCCGCCGTGGCCGCGGTGGAACTGGCCGACGAGGGACTGATCGTGCTGGGCAAAT (SEQ ID NO. 461)

TGGTCGATGGCACGCTGGCCGCCGATCTGAAGGTCN

Clone Rv350
::::::::::::Rv350SP6.seq::::::::::::
CTCAAGCTTGCCGTTACCCCGACTTCCGGAGGGACACCATGAGCACCGCCAGCCGAGCACGAGGCCAAACTCCGCCGA (SEQ ID NO. 462)

CGCAGGCCGGTTGGACTTGTCGTGCTGGACAAGGGGTTTAGCCGCCGAAGCAGTGACGTACATCGGCGAAAAGCAGTT

CGCCTGTCGACCGACGGNGCNNACCGTGAGGCTAGGGAAGCGAGGAGCACATGGCCGCCGACCCGCAATGTACACGCT

GCAAGCAAACCATCGAACCCGGATGGCTATNCNTCACCGCCCATCGCCGCGGT

::::::::::::Rv350T7.seq::::::::::::
CATGTCGCGCACATCCAGGACTTCTGGGGGGATCCGCTGACAGCGGCGGGATCCCAAAGTGCGGATGATCGGGCCGCC (SEQ ID NO. 463)

TACGTCGTGGTGTACCTCGTCGGTAACAACGAAACCGAAGCGTATGACTCGGTCCACGCGGTGCGGCACATGGTGGAC

ACCACACCGCCACCGCACGGGGTGAAGGCCTATGTCACCGGTCCGGCAGCACTCAATGCCGACCAGGCCGAGGCCGGA

GACAAAAGTATCGCTAAGGTCACCGCGATCACGAGCATGGTGATCGCAGCAATG

Clone Rv351
::::::::::::Rv351SP6.seq::::::::::::
ATACTCAAGCTTCGGTACGGTGGCGGGCCGTGCTGCTGGCCGCGGTCGCGGCGTGCGCGGCCTGCGGTCTCGTTTACN (SEQ ID NO. 464)

AGCTCGCGCTGCTGACACTGGCGGCNAGCCTGAACGGCGGCGGGATCGTGGCCACCTCCCTGATCGTCGCGGGCTACA

TAGCCGCGCTGGGAGCAGGCGCCTTGCTGATCAAGCCGCTACTTGCAGACGCGGCCATCGCGTTCATCGCCGTGGAGG

CGGTGCTGGGGATGATCGGCG

::::::::::::Rv351T7.seq::::::::::::
TGTCAAGTCCTTTCAGATCTCNTTTTTATGACATGACTGGAGATCTGTCTAGATTGCAGCTCCTGTGAGCGTGGGTAC (SEQ ID NO. 465)

CGGATTCAAGCCGGTCGGTCACGCCGCGGTGGTACCGGCTTTGCGGCAGTGCTCGGCCTCGAGTTCGGCGATCGCGCG

CGAAGTGCGTTCGCGCAGCAAGATCGCGGCCGTAATGCCGGCGATGACCGCGATGACCAGCGCGATCCAGGAGAACCG

TTCCAACCAGTGCTGGGCGGCCATCCCGGCGAAGTAGACCAGTGCAGTGGTGCC

Clone Rv352
::::::::::::Rv352SP6.seq::::::::::::
CAATACTCAAGCTTCAAAACAGGCCTGTTGTGGGCGCACCCGGCTCGCCGAGTTCTGCACGCACCGCCTCAANTGCGG (SEQ ID NO. 466)

CCCGCACCGCCGGCATCTCCCGGTCACGCAGGGCCGCGGCCCGCGCCGCANCGACGGNGTGTTCGCGCAGTTCGCCGT

CAATGATGCTGACCTGATCGGCCACCCGGGCGTTCTCGGCGTCGTCNCGTTCACTAATCGCGGTGCTC

::::::::::::Rv352T7.seq::::::::::::
TACGCTGGCGCTGGAGGGAGCCANNTACAACATCCACGCCAATGCTCTTGCCCCGATCGCGGCGACCAGGATGACCCA (SEQ ID NO. 467)

GGACATCCTGCCGCCCGAAGTACTGGAAAAGCTCACACCCGAGTTCGTCGCACCGGTGGTGGCCTACCTGTGCACCGA

GGAGTGTGCCGACAACGCATCGGTGTACGTCGTCGGTGGTGGCAAGGTGCAGCGAGTTGCGCTGTTTGGCAACGACGG

CGCCAACTTCGACAAACCGCCGTCGGTACAAGATGTTGCGGCGCGGTGGGCCGAGATCACCGATCTGTCCGGTGCGAA

AATTGCTG

Clone Rv353
::::::::::::Rv353SP6.seq::::::::::::
GCTTTTCCCGTCCGTCNNCGCTCAACCGCGTGAGGCCGAAGCGGNTGGTTACGACTCCCTGTTTGTGATGGACCACTT (SEQ ID NO. 468)

CTACCAACTGCCCATGTTGGGGACNCCCGACCAGCCGATGCTGGAGGCCTACACGGCCCTTGGTGCGCTGGCCACGGC

GACCGANCGGCTGCNNNTGGGCGCGTTGGTGACCGGCAATACCTACCGCAGCCCGACCCTGCTGGCAAANATCATCAC

CACGCTCGACGTGGTTAGCGCCGGTCGAGCGATCCTCGGCATTGGAGCCGGTTGGTTTGANCTGGAACA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv353T7.seq::::::::::::
CNGCTTTTTAATGGCCTTGACNTGGGCGNGCCGGCCACCGGGGCCACTCCGCACAATCTGTACCCGACCAAGATCTAC (SEQ ID NO. 469)

ACCATCGAATACGACGGCGTCGCCGACTTTCCGCGGTACCCGCTCAACTTTGTGTCGACCCTCAACGCCATTGCCGGC

ACCTACTACGTGCACTCCAACTACTTCATCCTGACGCCGGAACAAATTGACGCAGCGGTTCCGCTGACCAATACGGTC

GGTCCCACGATGACCCAGTACTACATCATTCGCACGGAGAACCTGCCGCTGCTAGAGCCACTGCGATCGGTGCCGATC

GTGGGGAACCCACTGGCGAACCTGGTTCAACCAAACTTGAAGGTGATTGTTAACCTGGGCTACGGCGACCCGGCCTAT

G

Clone Rv354
::::::::::::Rv354SP6.seq::::::::::::
CTCAAGCTTGCCGGGAGGGTGCATGGCCGACTCGGATTTACCCACCANGGGGCGCCAACGCGGTGTCCGCGCCGTCNA (SEQ ID NO. 470)

GCTGAACGTTGCTGCCCGCCTGGAGAACCTGGCGCTGCTGCGCACCCTGGTCGGCGCCATCGGCACCTTCGAGGACCT

GGATTTCGACGCCGTGGCCGACCTGAGGTTGGCGGTGGACGAGGTGTGCACCCGGTTGATTCGCTCGGCCTTGCCGGA

TGCCACCCTGCGCCTGGTGGTCGATCCGCGAAAANACGAANTTGTGGTGGAGGCTTCTGCTGCCTGCGACACCCACNA

CGTGGTGGCACCGGGCAGCTTTAGCTGGCAT

::::::::::::Rv354T7.seq::::::::::::
CCGACGCCGTCGTGGCCACCAACACCGCGACCAGCACCGTGACCCGGACCGGGGTGCCGCGCGAACCGGTCTTGGCCA (SEQ ID NO. 471)

ATTGCCGCGGCACCAAGCCGTCGCGCGCCATGGCGAACAGCACGCGGCATTGCCCGAGCATCAACACCATCACCACCG

TGGTAAGCCCGGCCAGCGCGCCGACGGAGATGATGCCGCTGGCCCAGTACACCCCGTTGGCCTGGAACGCGGTGGCCA

GATTTGCCGGCCCGCGGCCCGGTACGGTCCGCAGTTGGGTGTATGGAACCATGCCCGACAGCACCACCG

Clone Rv355
::::::::::::Rv355SP6.seq::::::::::::
TTNACTGGCCTTTGGTCCACACTAGACAATACTCAAGCTTCCAGGACATCGTCATCGCGACCAAAACCGCGAGCTAGG (SEQ ID NO. 472)

TCGGCATCCGGGAAGCATCGCGACACCGTGGCGCCGAGCGCCGCTGCCGGCAGGCCGATTAGGCGGGCAAATTAGCCC

GCCGCGGCTCCCGGCTCCGANTACGGCGCCCCGAATGGCGTCACCGGCTGGTAACCACGCTTGCGCGCCTGGGCGGCG

GCCTGCCGGATCAGGTGGTAAATGCCGACA

::::::::::::Rv355T7.seq::::::::::::
NGACGTCTTCCATCCGCGCGTCGTTTTGGCGGGTTGGCCACAGCAGCCCGCCGGTGACGGCGACGATGCTGGGCTGGT (SEQ ID NO. 473)

TGCGGCCCTGCGCCACCGCGGCTTGCATGCTGGTTGGCTGTCTTGGGACGATCCCGAAATAGTCCACGCGGATCTGGT

GATTTTGCGGGCTACCCGCGATTACCCCGCGCGGCTCGACGAGTTTTTGGCCTGGACTACCCGCGTGGCCAATCTGCT

GAACTCGCGGCCGGTGGTGGCCTGGAATGTCGAGCGCCGTTACCTA

Clone Rv356
::::::::::::Rv356SP6.seq::::::::::::
CTTCCTCCTGAGTACCNCCCGTNTACTTTGGGATGGGTAAAAAGGCGAATCNCCGTTTGGTCACGAACGCCGGGAGGG (SEQ ID NO. 474)

ACAATCTCGGGCGGCTGGGGCCTCTCGCGGGAANGCCCGAATGTACGGTGTCTCGACACTTCCCNTCCCCCTCCG

::::::::::::Rv356T7.seq::::::::::::
GAGCATCGGGACNTACGGAGTCAACTACCCGGCCAACGGTGATTTCTTGGCCGCCGCTGACGGCGCGAACGACGCCNC (SEQ ID NO. 475)

CGACCACATTCAGCAGATGGCCAGCGCGTGCCGGGCCACGAGGTTGGTGCTCGGCGGCTACTCCCAGGGTGCGGCCNT

GATCNACATCGTCACCGCCGCACCACTGCCCGGCCTCGGGTTCACGCAGCCGTTGCCGCCCNCAGCGGACGATCACNT

CGCCGCGATCGCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv357
::::::::::::Rv357SP6.seq::::::::::::
TACTCATGANCATCCTTTAATCANNGCTTTGCGTTTTTTTATTAAATCTTGCAATTTACTGCAAAGCAACAACAAAAT (SEQ ID NO. 476)

CGCAAAGTCATCAAAAAACCGCAAAGTTGTTTAAAATAAGAGCANCACTACAAAAGGAGATAAGAAGAGCACATACCT

CAGTCACTTATTATCACTAGCGCTCGCCGCAGCCGTGTAACCGAGCATAGCGAGCGAACTGGCGAGGAAGCAAAGAAG

AACTGTTCTGTCAGATAGCTCTTACGCNCA

Clone Rv358
::::::::::::Rv358SP6.seq::::::::::::
CTCAAGCTTCAGGTCAATGTGCNCCAAGCCCTGACGCTGGCCGACCAGGCCACCGCCGCCGGANACNCTGCCAAGGCC (SEQ ID NO. 477)

ACCGAATACAACAACGCCGCCGAGGCGTTCGCANCCCAGCTGGTGACCGCCGAGCANANCGTCAAAAACCTCAAGACG

CTGCATGACCAGGCGCTTANCNCCGCANCTCAGGCCAAGAAGGCCGTCNAACGAAATGCGATGGTGCTGCACCANAAG

ATCGCCGAGCGAACCAAGCTGCTCAGCCNG

::::::::::::Rv358T7.seq::::::::::::
CATGGTGGCACTGTAGCGACGTGCTGCAATCAAGGTCATGCCCGACTCTGGTCAGCTCGGANCCCCTGACACCCCGCT (SEQ ID NO. 478)

AAGGCTGCTCAGCTCGGTGCATTACCTCACCGACGGCGAACTCCCCCAGCTTTACGACTATCCGGATGACGGCACCTG

GTTGCGGGCGAACTTCATCATCAGCTTGGACGGCGGCGCTACCGTCGATGGCACCAGCGGGGCGATGGCCGGGCCCGG

CGACCGATTCGTCTTCAACCTGTTGCGTGAACTTGCCGACGTCATCGTGGTCGGCGTGGGCACCGTGCGCATTGAGGG

CTACTCCGGCGTCCGGATGGGTGTCGTCCAGCGCCAGCAC

Clone Rv359
::::::::::::Rv359SP6.seq::::::::::::
TACTCAAGCTTGCGGGTGATCGCCTTGGTCAACGGCACCGTGATCGGATCGGGGTCNACCGCACAAATGGACTGGAGC (SEQ ID NO. 479)

TTCGGCGAANTCATCGCCTATGCCTCGCGGGGGGTGACGCTGACCCCGGGTGACNTGTTCGGCTCGGGCACGGTGCCC

ACCTGCACGCTCGTCTATCACCTCNGGCCACCGGAATCATTCCCGGGCTGG

::::::::::::Rv359T7.seq::::::::::::
GTTGGNGCCTCGTCGGCGAACAGTTCTCGCACGATTTCCGGATTAGCGGGACTGGTCACCAGTTGGGTATGCGGGAAG (SEQ ID NO. 480)

GCGCTGACGTTCGCCGCGATTAGCTGTTTGATGGACGCGGTGGTGATGTTCTGATCACGGAACTGGCTGTAATAGCCC

AGGGTCGCCACGCTTTCATCCGGGCCCGGACCCGGCGCACCGAGCGTGTCGCGCAGGTATGCGACGTGATTTTCGCTG

AAGTCCCCGTACCCGGAGAACT

Clone Rv35
::::::::::::Rv35SP6.seq::::::::::::
TGCTTCCGGCTCGTATGTTGTGTGGAATTGTGANCGGATAACAATTTCACACAGGAAACAGCTATGACCATGATTACG (SEQ ID NO. 481)

CCAAGCTATTTAGGTGACACTATAGAATACTCAAGCTCCAGGTCAATGTGCGCCAAGCCCTGACGCTGGCCGACCAGG

CCACCGCCGCCGGAGACGCTGCCTTTGTCACCGAATACAACAACGCCGCCGAGGCGTTCGCAGCCCAGCTGGTGACCG

CCGAGCAGAGCGTCGAAGACCTCAAGACGCTGCATGACCAGGCGCTTAGCGCCGCAGCTCAGGCCAAGAATGCCGTCG

AACGAAATGCGATGGTGCTGCGGCATAAGATCGCCGAGCGAACCAAGCTGCTCAGCCAGCTCGAGCAGGCGAAGATGC

ACGAGCA

::::::::::::Rv35T7.seq::::::::::::
CAGGCATGCAAGCTTCGGAGGCAGACCCGTGCATGGTGGCACTGTAGCGACGTGCTGCAATCAAGGTCATGCCCGACT (SEQ ID NO. 482)

CTGGTCAGCTCGGAGCCGCTGACACCCCGCTAAGGCTGCTCAGCTCGGTGCATTACCTCACCGACGGCGAACTCCCCC

AGCTTTACGACTATCCGGATGACGGCACCTGGTTGCGGGCGAACTTCATCAGCAGCTTGGACGGCGGCGCTACCGTCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

ATGGCACCAGCGGGGCGATGGCCGGGCCCGGCGACCGATTCGTCTTCAACCTGTTGCGTGAACTTGCCGACGTCATCG

TGGTCGGCGTGGGCACCGTGCGCATTGAAGGCTACTCCGGCGTCCGGATGGGTGTCGTCCATCGCCA

Clone Rv360
::::::::::::Rv360SP6.seq::::::::::::
TACTCAAGCTTGGGGTGGCGCTGTCGGTCGGTGTGCTTGGCGGCGTCGGTATCAACACCGCCCACGAAATGGGGCACA (SEQ ID NO. 483)

AGAAGGATTCGCTGGAGCGGTGGCTGTCCAAAATCACCCTCGCCCANACCTGCTACGGGCACTTCTACATCGAGCACA

ACCGTGGCCATCACGTCCGGGTGTCCACACCGGAGGACCCGGCGTCGGCGCGGTTCGGCNAAACGTTGTGGGANTTCC

TGCCCCGCANTGTTATCGGCGGCTTGCGCT

::::::::::::Rv360T7.seq::::::::::::
GGCCATCGCCACCGCNCCGCGGCGAACGCTCAAAGGCACCTACTGGCACCAAGGCCCCACACGTCACCCTGTGACCTC (SEQ ID NO. 484)

CTGCGCCGACCCCGCCCGAGGTCCTGGCCGTTACCACCGAACGGGCGAGCCGGGAGTCTGGTACGCATCGAACAAAGA

GCAAGGTGCATGGGCGGAGTTGTTCCGCCACTTCGTCGATGACGGGGTCGATCCATTCGAGGTCCGTCGCCGCGTCGG

TCGAGTGGCGGTCACACTCCANGTACTCGACCTCACAGACGAGAGGACTCGATCCCATCTAGGTGTGGACGAAACAGA

TCTTCTGTCCGACGACTACACCACCACCCAGGCCATCGC

Clone Rv361
::::::::::::Rv361SP6.seq::::::::::::
GCTTGCGGGTGATCGCCTTGGTCAACGGCACCGTGATCGGATCGGGGTCNACCGCNCAGATGGACTGGANCTTCGGCG (SEQ ID NO. 485)

AANTCNTCGCCTATGCCTCGCGGGGGGTGACCCTGACCCCGGGTGACNTGTTCGGCTCGGGCACGGTGCCCACCTGCA

CGCTCGTCAAGCACCTCNGGCCACCGGAATCATTCCCGGGCTGGCTGCACNACGGCGACNTGGTCNCCCTCCAGGTCG

AAGGGCTGGGCNAAACAANGCAGACCGTCCGGACAANCGGCACTCCTTTTCCGTTGGCTCTTCGGCCGAATCCGGACG

CCNAACCCGACCGGCG

::::::::::::Rv361T7.seq::::::::::::
GTTCTCGCACGATTTCCGGATTAGCGGGACTGGTCACCAGTTGGGTATGCGGGAAGGCGCTGACGTTCGCCGCGATTA (SEQ ID NO. 486)

GCTGTTTGATGGACGCGGTGGTGATGTMCTGATCACGGAACTGGCTGTAATANCCCAGGGTCGCCNCGCTTTCATCCG

GGCCCGGACCCGGCGCACCGAGCGTGTCGCGCAGGTATGCGACGTGATTTTCGCTGAAGTCCCCGTACCCGGAGAACT

CGAACACGCTGAGGCGCTCGTCACCGTCGTNNCGGCGACCAAGCGCGGCGAGCAACTGCGCAAAATCGTTAAGANAGG

TCGAATCGTTGAAATTCGGCACCACCTGCACC

Clone Rv363
::::::::::::Rv363SP6.seq3::::::::::::
CACAAGACAATACTCAAGCTTCAGGTCAATGTGCNCCAAGCCCTGACGCTGGCCGACCAGGCCACCGCCGCCGGANAC (SEQ ID NO. 487)

GCTGCCAAGGCCACCGAATACAACAACGCCGCCGAGGCGTTCGCAGCCCAGCTGGTGACCGCCGAGCANANCGTCNAA

AACCTCAAGACGCTGCATGACCAGGCGCTTANCGCCNCAGCTCAGGCCAAGAAGGCCGTCGAACGAAATGCGATGGTG

CTGCAGCANAANATCGCCGANCGAACCAAGCTGCTCAGCCAGCTCGAGCAG

::::::::::::Rv363T7.seq::::::::::::
CCACCCGTGCATGGTGGCACTGTAGCGACGTGCTGCAATCAAGGTCATGCCCGACTCTGGTCAGCTCGGAGCCGCTGA (SEQ ID NO. 488)

CACCCCGCTAAGGCTGCTCAGCTCGGTGCATTACCTCACCGACGGCGAACTCCCCCAGCTTTACGACTATCCGGATGA

CGGCACCTGGTTGCGGGCGAACTTCATCAGCAGCTTGGACGGCGGCGCTACCGTCGATGGCACCAGCGGGGCGATGGC

CGGGCCCGGCGACCGATTCGTCTTCAACCTGTTGCGTGAACTTGCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv364
::::::::::::Rv364SP6.seq::::::::::::
GCTTTCCGCCGATACCCNCCATGTCCCGCACATCCAGGACTTCTGGGGGGATCCGCTGACAGCGGCGGGATCCCAAAG (SEQ ID NO. 489)

TGCGGATGATCGGGCCGCCTACGTCGTGGTGTACCTCGNCGGTAACAACGAAACCGAANCGTATGACTCNGTCCACGC

GGTG

::::::::::::Rv364T7.seq::::::::::::
CAACCCGANTTGGCTTTCGGCGCCNTCGGTGAGGACGGCGTGCGGGTGCTCAACGACGACGTCGTCCGCGGGACACAC (SEQ ID NO. 490)

CTCGATGCTGCCGCCATGGACGCGGTCGAACGCAAGCAGCTGATCGATCTACNACGCCGNGNGGAACGCTTCNGCCGC

GGGCGTGACCGCNTCCCGTT

Clone Rv365
::::::::::::RV365SP6.seq::::::::::::
GGGATGGGCAAAAAGGCGAAGCACCGCGTGGCCACGAACGCCGGGAGGGACAATCTCGGGCGGCTAGGGCTTCTCGCG (SEQ ID NO. 491)

GGAAGGCCCGAACGTACGGCGTTTCAACACGTCGCGTCGCCCTCCGACCGCGAACATTCGGGGATGGCAGCAACCTGG

TAGCACCCTGGCCGGGCGATGATCTGCCAGCGTCCCCGCGGGTAGTCGCCGCCCGGGCGG

::::::::::::Rv365T7.seq::::::::::::
CAGCAGACCAACAAGAGCATCGGGACATACGGAGTCAACTACCCGGCCAACGGTGATTTCTTGGCCGCCGCTGACGGC (SEQ ID NO. 492)

GCGAACGACGCCAGCGACCACATTCAGCAGATGGCCAGCGCGTGCCGGGCCACGAGGTTGGTGCTCGGCGGCTACTCC

CACGGTT

Clone Rv366
::::::::::::Rv366SP6.seq::::::::::::
CTCAAGCTTGACTGGCCACCCACCGGCATGACCACCGACAGGCCCGACTGGTCGTACCACTCGAACGCCGGGGTGTTT (SEQ ID NO. 493)

GA

::::::::::::Rv366T7.seq::::::::::::
TTGGTGCCCGGAATGGCGAGTCCCATTTANTCGCTGATTTGTTTGAACAGCGACGAAACCGGTGTTGAAAATGTCGCC (SEQ ID NO. 494)

TGGGTCGGGGATTCCCTCTCCAAGCAAGAGTAACTGGCCCCAAATAAAGTTACTCGTCGTCTTGCAAAGACCGCTACC

CGATGCCATTTATGTGTTTCCTTACGCTCNNNNTTCCGGTGCGCCATCATTATCTGCACCTTTGCACTGCACATTGAG

CTTAGCAGCGCTCG

Clone Rv367
::::::::::::Rv367T7.seq::::::::::::
GAATTNGCTTTCGGCGCCATCGGCCCAGGACCGCGTGCGGGTGCTCAACGACGACGTCGTCCGCGGGACACACCTCGA (SEQ ID NO. 495)

TGCTGCCGCCATGGACGCGGTCGAACGCAAGCAGCTGATCGAGCTACAACGCCGCGCGGAACGCTTCCGCCGCGGGCG

TGACCGCATCCCGTTGACCGGGCGGATCGCNGTGATCGTCGATGACGGCATCGCCACCGGAGCGACGGCCAAGGCGGC

GTGCCAGGTCGCCCGGGCGCACGGTGCGGACAAGGTGGTGCTGGCGGTCCCGATCGGCCCAGACGACATCGTGGCGAG

ATTCGCCGGGTACGCCGATGAAGTGGTGT

Clone Rv368
::::::::::::Rv368SP6.seq::::::::::::
TAAAGCTTTCGTCAGTTCATNGNGCCCCCGGACCAACAAAAGCATCGGGACATACGGAGTCAACTACCCGGCCAACGG (SEQ ID NO. 496)

TGATTTCTTGGCCGCCGCTGACGGCGCNAACGACGCCAGCGACCACATTCAGCAGATGGCCAGCGCGTGCCGGGCCAC

GAGGTTGGTGCTCGGCGGCTACTCCCAGGGTGCGGCCGTGATCNACATCGTCACCGCCGCACCACTGCCCGGCCTCGG

GTTCACGCAGCCGTTGCCGCCCGCAGCGGACGATCACNTCGCCGCGATCGCCCTGTTCGGGAATCCCTCGGGCCGCGC

TGGCGGGCTGATGAGCGCCCTGACCCCTCAATTCGGGTCCAANACCATCNACCTCTGCAACAACGGCGACCCGATTTG

TTCGGACGGCAACCGGTGGCGANCGCACCT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv368T7.seq::::::::::::
CCGGGAGGGACCATCNCGGGCGGCTNCGGCTTCTCTCCGGAAGGTTCTANNGTNNNGCGTTTCNACNCTTCCCGTCGC (SEQ ID NO. 497)

CCTGCGACCGCCGAACATTCGGGGTATGGNNGCANCCTGTNAGCATCCNGGCCGGGC

Clone Rv369
::::::::::::Rv369SP6.seq::::::::::::
CTCAAGCTTCCGCATCAGATCGCTATAGAACCGGTGCGCGTCCCCACCGAGTGGCTGGTCGCCTTCCAGCACGATCGT (SEQ ID NO. 498)

TACCGCGTTATCGGAATCAAACTCNCCGAACACCTGACCAACGCGCTTGATCGCCTGAATCGATGCGGCGTCGCTGGG

GCTCATCGATACCGAGTGTGCTTTTCCGACCACTTCCAGTTGCGGTACGGCGAGATTGACAAAGGCGGTGAAGCCCAG

CCAGAGCAGGACGATCACCNCCGCAAACCGGCGGATTTGCCCG

::::::::::::Rv369T7.seq::::::::::::
GCTTGGCAGCCTGCGGCTGGGCGCCCTNGAGCTCTTCGATCTGGATCTCCGGACTCGAGATGCTCACTTGCCCGGCCG (SEQ ID NO. 499)

TGGACGTACCCATTGCGGCCGGGACCCCAGCGCCCCAGGTGACCAGCGAGTTGGGCTGCACGCTGACCGGCCCGTCGG

GGTCGACGCCGGTAACGGTCAGCAGCTCCGANGTCCNNCTGATCCCGACCGCAGCTGCCAATGCGCGGCTGGCAGCCG

ACGTGGATGTGCCGGGGCCTAGATCGCGGGGCAGCAGCGAGACCGCGTCACCGACGGTCATCACCTTGCCGAGTTTNG

GCCTGCCGCAN

Clone Rv36
::::::::::::Rv36SP6.seq::::::::::::
GCTTCCGGCTCGTATGTTGTGTGGAATTGTGAGCGGATAACAATTNCACACAGGAAACAGCTATGACCATGATTACGC (SEQ ID NO. 500)

CAAGCTATCTAGGTGACACTATAGAATACTCAAGCTTGAGCCATCGGGCTATCAGCTGGTTGATGTCCCG

::::::::::::Rv36T7.seq::::::::::::
CAGGCATGCAAGCTTGTCGTCTATCACATCCGACCACCAACCGCCCGACGGCTCGGCAGAACGCCTCCGCATATGGGT (SEQ ID NO. 501)

CGACGACCAGCGGGTCGGACTTCTGGGCTGCCAGCGCTCGCGCCGTCGCGACAAACAGCGCGGTCGAACCGACACTCC

TTGTGATGTCCCACCTATCACCTTCGGTACGCACCCAATCGACCCTACGCGGCTAGCTCAGCCCCGATCTTCCAGAGC

TCCGCCCG

Clone Rv370
::::::::::::Rv370SP6.seq::::::::::::
GCTTTTTGAGCGTCGCGCGGGGCCGCTTCCCCGGCAATTCTACTAGCGAGAAGTCTGGCCCGATACGGATCTCACCGA (SEQ ID NO. 502)

AGTCGCTGCGGTGCAGCCCACCCTCATTGGCGATGGCGCCGACNATGGCGCCTGGACCGATCTTGTGCCGCTTGCCGA

CGGCGACGCGGTAGGTGGTCAATTCCGGTCTACGCTTGGGCCTTTGCGGACGGTCCCGACGCTGGTCGCGGTTG

::::::::::::Rv370T7.seq::::::::::::
CGANCCTGTTCGACGGCTACCTGAATCACCCCGATNCCACCGCCGCGGCGTTCGACGCCGACAGCTGGTACCGCACCG (SEQ ID NO. 503)

GCGACGTCGCGGTGGTCGACGGCAGTGGGATGCACCGCATCGTGGGACGCGAGTCGGTCGACTTGATCAAGTCGGGTG

GATACCGGGTCGGCGCCGGTGAAATTGAAACGGTGCTGCTCGGGCATCCGGACGTGGCGGAGGCGGCAGTCGTCGGGG

T

Clone Rv371
::::::::::::Rv371SP6.seq::::::::::::
NAAGCTTTGTCACACCAAGTGTTTCNACCAGNCGCTCCATCCGGCGAAGTGGATACTCCCAGCAGGTAGCAGGTCGCC (SEQ ID NO. 504)

ACCACGCTGGTCAGTGCGCGTTCAGCTCGCTTGCGGCGCTGCAGCAGCCAGTCCGGGAAATAGCTGCCCTGGCG

::::::::::::Rv371T7.seq::::::::::::
CGCTGGNCGCCGGCGCTGGGCTGCGGTAACCAATTACCACAACACTTTTCGGTAGCCGAACAGCGGCGCGTACCAGCG (SEQ ID NO 505)

AAATGGCACAGCCACCGCAGTCGCCGACATCCCGCGAAGATGTGGCAGATTTTCGTGCGGTCGAGCCGGCGAAGGCCT

AGCGTCATTGTTGCCTGGCAAGGTTGCTGGGCCCGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv373
::::::::::::Rv373SP6.seq::::::::::::
CTCAAGCTTCTTCTGCCCCTTGCCGTTNCGGATNACATCCGGCAGCGACTCGGCTTCGGCGTCGATGTCGAAGTTCTC (SEQ ID NO. 506)

GATCAGCTTCTGGATCGACTCCGCGCCCATGGCACCGGTGAAGTACTCGCCGTAGCGGTCGACNAGTTCGCGGTAGAG

GTTTTCGTCNACNATCAGCTGCTTGGGCGCCANCTTGGTGAAAGTGCTCCAAATGTCCTCCAACCGGTCCAGCTCACG

CTGCGCGCGGTCACGGATCTGGCGCATCTCGCGCTCGCCGCCGTCGCGAACTTGCGCCGCGCATCGGCCTTGGGGCCC

::::::::::::Rv373T7.seq::::::::::::
GTTCACACCTACCTACTATGCCNCAATTCNCCGACACGGGTGGCATCAACACGGGCGATAAGGTGGAAATCGCTGGGG (SEQ ID NO. 507)

TGAACGTCGGGCTGGTGCGCTCGCTGGCAATCCGCGGCAACCGCGTGTTGATCGGATTCTCGTTCCCCGGCAAGACAA

TCGGGATGCAAAGCCGGGCAGCAATTCNCNCCNACACCATTCTTGGCCGTAAGAACCTGGAGATCGAACCCCGCGGTT

CGGAGCCGTTGAAACCCAACGGTTTCCTGCCGTTGGCGCANACCACTACGCCATACCAAATC

Clone Rv374
::::::::::::Rv374SP6.seq::::::::::::
CTCAAGCTTTACGCCGACGCCGGCCTACACAACACCAAGGAAACGATTGCCTACTGCCGAATCGGGGAACGGTCCTCG (SEQ ID NO. 508)

CACACCTGGTTCGTGTTGCGGGAATTACTCGGACACCAAAACGTCAAGAACTACGACGGCAGTTGGACAGAATACGGC

TCCCTGGTGGGCGCCCCGATCGAGTTGGGAAGCTGATATGTGCTCTGGACCC

::::::::::::Rv374T7.seq::::::::::::
TCCCNCATGGGATAACGGGTTTAGATTTCNACAACGGCACCGTGTTTCTCAACAAGCCGGTCATCAGCTGGGCCGGCG (SEQ ID NO. 509)

ACAACGGTATCTACTTCACCCGCTTTCGCCCGTACAAGAAAAACCACTAGGCCACCATCGAGTCCAAGAACAACCACC

TGGTCCGCAAGTACGCGTTCTACTACCGCTATGACACCGCCGAGGAACGCGCCGTGCTCAACCGGATGTGGAAGCTGG

TCAACGACCGCCTCAACTACCTCACCCCGACCATCAAACCGATC

Clone Rv375
::::::::::::Rv375SP6.seq::::::::::::
CTCAAGCTTGGGTGTTGCCGATCACCGGAAGCCNCATGATCAGCCACGTTTCGCGCCGCCCGGCATACGGCGGCGTAC (SEQ ID NO. 510)

CGATCTCCGCGTCATACACCCGCGGGTAATCGCCGACGGTGCCGGTTCGCGAGCCGAAGGTGACAACGCTGATTGAAT

CNAGTTCCANGTCCAGCGGGT

::::::::::::Rv375T7.seq::::::::::::
TNAACAGCTCGCGGCAGCCCACGACCTGCTGCGTCGGATTGCCGGCGGCGAGATCAATTCCAGGCAGCTCCCGGACAA (SEQ ID NO. 511)

TGCGGCTCTGCTGGCCCGCAACGAANGACTCGAGGTCACCCCGGTGCCCGGGGTCGTGGTGCACCTGCCGATCGCACA

GGTTGGCCCACAACCGGCCGCTTGATGNNNNGTCGGCAAGCCCGGCAGTNGCCAAACCCAGCGTGATCANGCTCGGCT

CGCGAGTTCGGCGAANAAGTGGCTCGCCTGATCACCTACCATCGGCCANGATCTGCGTGTCA

Clone Rv376
::::::::::::Rv376SP6.seq::::::::::::
GCCANCCGGCTTGGCGTCGACTCCCGTTCNGCACATCATACGGTCCCCGGTACTGTCCAACTGCGCCGGTGCGCTAGC (SEQ ID NO. 512)

CAAACGTCACGACTCTCAGTGATCCCAGTTCGTGATCCGGCCGGTGGCCCCGCTGCGGCGGGGGCTNATNTACTTCGG

ACTNATTATCTCATCCAAAGGACACCGGGCCGGTGGCTGGAATCCCATGGTGCGATCGGCCACACAN

::::::::::::Rv376T7.seq::::::::::::
CCGACCTGGTATCTTCCGATAGCGCGCGTTGATATCCGGTCTGATCTCCTGCCCTTAACGCCGGATCTCAGCAGGTCC (SEQ ID NO. 513)

CCATGCAAAGATCCGAGGTGTCCCNGATCTAGGGGTCCTCGTCCTCCAGATGATGGAGCAAGTCGGCCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv377
::::::::::::Rv377SP6.seq::::::::::::
CTCAAGCTTCGGCTCAGGCGGCGCTGCCGGTAACGTCGCTGACCGGTGCAGGTTTCGACAATGTGGTGCCGGTTCGGC (SEQ ID NO. 514)

GGCTACGTGCCATCAAGACACTGGCGCAGGCTATCGCACCCGTTATCGGCTACAAACAAATCGCGGTATGC

::::::::::::Rv377T7.seq::::::::::::
CATCACCTGNTTCATGAACTGGAAGCACCGCAGCGCTTCCTTTTCGGCCGCAACATGAGCCAGCCTCTCGTCGGCGGT (SEQ ID NO. 515)

CGGGTGCAGGTGCTCGGGCAGCTCGGCCGCGACAGCCGCCTGACCCTGAAACCAGCTTCCATATCCCGCGACGAACGA

CGCCAGTCCGCTACGTAACCCCTCCGCGACTGTCCATGGACAACAGCGCGTTCTCCACCGACCGGGCCCGGGTGTGGG

GTGT

Clone Rv378
::::::::::::Rv378SP6.seq::::::::::::
AGCTTAGCTTCCCGCCCCGGCAATAGGGCTCCAGCTCATCCGGTGTGACCAGATAGGGGCCCAGGGTGATACCGCTGT (SEQ ID NO. 516)

CTTTGCCCTTGGCCTGTCCGATGCGCAGCTGGCCCTCCAGCATCTGCAGGTCCCGTGCGGACCAGTCGTTGAAAATGG

TATAGCCGATGATCGACCG

::::::::::::Rv378T7.seq::::::::::::
CCNGAACAGAAGCGGNGGTTCCTACCGCGGTGTGCGGCCGGCGCGATATCGGCCTTTTTACTAACCGAACCCGATGTG (SEQ ID NO. 517)

GGCTCCGATCCGGCGCGCATGGCATCGACGGCGACGCCGATCGATGACCGCCAGGCTTACCACCTT

Clone Rv379
::::::::::::Rv379SP6.seq::::::::::::
CTCAAGCTTGCGCGACTCGAGAAGCATTCTTGACAGTTGTTTTGGCTCGGCATGGTTAGCCAAGGTTCTGCGGTCCCA (SEQ ID NO. 518)

CCAGATCATCTTGGTCCGGTAGCGCTCGTCCGGGTATGCTGCCGCCGGGATTCTCGCTGCTATTACTCCCCCCGAAGA

ACGCCACCGGTCCAGCGC

::::::::::::Rv379T7.seq::::::::::::
GCNAGGCGGTATAGCTTCCCGTCGTACCGGCGACCGCCAGCCGAGAAGCTCGTTTTCCCAGTGTTGCTGGGGATTCTC (SEQ ID NO. 519)

ACGCTGCTGCTGAGTGCGTGCCAGACCGCTTCCGCTTCGGGTTACAACGAGCCGCGGGGCTACGATCGTGCGACGCTG

AAGTTGGTGTTCTCCATGGACTTGGGGATGT

Clone Rv37
::::::::::::Rv37SP6.seq::::::::::::
GTGTGGAACCGTGAGCGGATAACAATTTCACACAGGAAACAGCTNTGACCTTGATTACGCCAAGCTATTTAGGTGAGG (SEQ ID NO. 520)

CTATATTAATACTCAAGATTGCGGTCGAGCACATCGGCCCAAGAACCGCCGAAGGCACGGCGGAACGCCTGCGGCACA

TGGGGCGACGACCAGCGGGTCGGACTTCTGGGCTGTCCAGCCGGATCGCGCCGTCGCGA

::::::::::::Rv37T7.seq::::::::::::
CACTGTCAGTACATATGCGCCGCTCCTCCTCATCGCTGCGCTCGGCATCGTCGCCGGCGGTCATGGCGTCACCCTACC (SEQ ID NO. 521)

CAAGCCGAACGCGAAACGAGAACGTGTTCCATTATTAGGGTGTGAGCACCAATACCAGATTGCTCACCAGGAACTCAC

GCAGCACCGGGACGGATGTCAGCCACCACGCCCATCTGGGGTGGTAGCGGGGAAATACGGCTAACGCGGCTCCGGTGC

CGGCAGCCCAGCGCAGACCCTCGGCGGCGGACACGGCAAACAACGACGACCCATAGTTGTTCTTTGCCGGATGGCCGT

GTTTGCGGACATATCGGGCGGCGGCGCGGGCGCCGCCGAGGTAGTGGCTGAGGCCCATCTCGTGCCCGCCGAATGGCC

CCAGCCAAACCGTGTA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv381
::::::::::::Rv381SP6.seq::::::::::::
CTCAAGCTTTTACGGTGATCGCGCATCACCTGGTTCATGAACTGGAAGCAGCGCAGCGCTTCCTTTTCCGCCGCAACA (SEQ ID NO. 522)

TGAGCCANCCTCTCGTCGGCGGTCGGGTGCAGGTGCTCGGGCAGCTCGGCCGCGACAGCCGCCTGACCCTGAAACCAG

CTTCCATATCCCGCGACNAACGAC

::::::::::::Rv381T7.seq::::::::::::
CTCAGAAGCCGCTAGCTGGTAGAGTCGCTGACCGGTGCACGTGGCGNCAATGTGCGCTGCCGGTTCGCG (SEQ ID NO. 523)

Clone Rv382
::::::::::::Rv382SP6.seq::::::::::::
CTCAAGCTTGCGCTCATCAAGCGCGAACAGCAGGGCGGTCGGCTGGTCGCCATGACGGGTGACGGGACCAATGACGCA (SEQ ID NO. 524)

CCCGCGCTCGCGCAAGCCGATGTCGGGGTGGCNATNAATACCGGCACCCAGGCGGCCCGGGAAGCCGGCAACATGGTC

NATCTCCACTCC

::::::::::::Rv382T7.seq::::::::::::
ACTTCTATTTCGACTGGTGTGCTGTGGCGCGATCCGACTGCCGGCGTGGTCAAGGCCGGCCAGTTGTGGGATNCCACA (SEQ ID NO. 525)

GGCAC

Clone Rv353
::::::::::::Rv383SP6.seq::::::::::::
GCTTGTCGTATTCCGTGGCACTGTCAGACATATGCGCCGCTCCTCCTCATCGCTGCGCTCGGCATCGTCGCCGGCGGT (SEQ ID NO. 526)

CATGGCGTCACCCTACCCAAGCCGAACGCGAAACGAGAACGTGTTCCATTATTAGGGTGTGAGCACCAATACCAGATT

GCTCACCAGGAACTCAC

::::::::::::Rv383T7.seq::::::::::::
CGATATTCGTCGGCCGCGTTGTCTCGACTGGGTCGCGT (SEQ ID NO. 527)

Clone Rv384
::::::::::::Rv384SP6.seq::::::::::::
GACCTCGGCCACCAAGCCGGACGCGACCGTCGAGGTGGCGATCCGGCTTGGCGTCGACCCGCGTAAGGCAGACCACAT (SEQ ID NO. 528)

GGTCCGCGGCACGGCCANCCTGCCACACGGCACTGGTAAGACTGCCCGCGTCGCGGCN

::::::::::::Rv384T7.seq::::::::::::
CCGGAAGTCTAGGGGACGACCTACTCAGCGCAAAATGTCGCTAATGTGAGTCCGCCCCACCAGGGCAGATCAACCCAT (SEQ ID NO. 529)

GTCGATGATGACCTACCCGGATACCGGATTGGCGGT

Clone Rv385
::::::::::::Rv385SP6.seq::::::::::::
AGCTTCAGTTCCTCCACGACGCGTTCCCAAATGAATTTCCCGATCCCACAATCTCGGTTCAGATACAGGTCGCCATAC (SEQ ID NO. 530)

CCCTTACTTCGGNAACGCTGGGCGGATTGGCCCTGCCGCTG

::::::::::::Rv385T7.seq::::::::::::
CCGCCTACGGGTCGAACATGCATCCCGAGACCGATGCTCGAGCGCGCACCCCACTCGCCGATGGCCGGAACCGGCTGG (SEQ ID NO. 531)

TTACCCGGGTGGCGGCTGACC

Clone Rv386
::::::::::::Rv386SP6.seq::::::::::::
GCGGCTGGTTACGACTCCCTGTTTGTGATGGACCACTTCTACCAACTGCCCATGTTGGGGACGCCCGACCAGCCGATG CTGGAGGCCTACACGGCCCTTGGTGCGCTGGCCACGGCGACCGAGCGGCTGCAACTGGGCGCNTTCGTNACCGGCAAT (SEQ ID NO. 532)

ACCTACCGCAGCCCGACCCTGCTGGCAAAGATCATCACCACGCTCGACGTGGTTAGCGCCGGTCGAGCGATCCTCGGC

ATTGGAGCCGGTTGGTTTGAGCTGGAACACCGCCAGCTCGGCTTCGAGTTCGGCACTTTCAGTGACCGGTTCAN

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv386T7.seq::::::::::::
GCCTTTCCGCACAATCTGTACCCCAGGACCNTCTAAAAAATCGAATACGACGGCGTCGCCGACTTTCCGCGGTACCCG

CTCAACTTTGTGTCGACCCTCAACGCCATTGCCGGCACCTACTACGTGCACTCCAACTACTTCATCCTGACGCCGGAA

CAAATTGACGCAGCGGTTCCGCTGACCANTNNGTGCGGTCCCACGATGACCCAGTACTACATCATTCGCACGGAGAAC

CTGCCGCTGCTAGAGCCACTGCGATCGGTGCCGATCGTGGGGAACCCACTGGCGAACCTGGTTCAACCAAACTTGAAG (SEQ ID NO. 533)

GTGATTGTTAACCTGG

Clone Rv387
::::::::::::Rv387T7.seq::::::::::::
GCAGACCAACAAGATGCATCGGGATCATACGCCGTCAACTACCCGGCCAACGGTGATTTCTTGGCCGCCGCCCAC (SEQ ID NO. 534)

Clone Rv388
::::::::::::Rv388SP6.seq::::::::::::
CTCAAGCTTGCCAAAGAGACCTCGTCCACCAAGCNGGACGCGACCGTCNAGGTGGCGATCCGGCTTGGCGTCCACCCG (SEQ ID NO. 535)

CGTAAGGCANACCANATGGTTCGCGGCACGGTCAACCTGCCACACGGCACTGGTAANACTGCCCGCGTCGCGGTATTC

GCGGTTGGTGAAAAGGCCGATGCTGCCGTTGCCGCGGGGGCGGATGTTGTCGGGAGTGACAATCTGATCGANAGGATT

CAGGGCGGCTGGCTGGAATTCGATGCCGCGATCGCGACACCGGATCAGATGGCCAAAGTCGGTCNCATCGCTCGGGTG

CTGGGTC

::::::::::::Rv388T7.seq::::::::::::
CCACGGCCTGGATCAAGGTACCGGCCGGGATGTTGCGCAATGGCAGGTTGTTGCCCGGCTTGATGTCGGCGTTAGCGC (SEQ ID NO. 536)

CGGATTCCACCACATCCCCTTGCGAAACTCCGTTGGGTGCAATGATGTACCGCTTCTCCCCATCGAGATAGTGGAGCA

ACGCAATCCGTGCGGTACGGTTCGGGTCNTACTCGATGTGCGCGACCTTGGCGTTGACACCATCTTTGTCATTGCGGC

GAAAGTCGATCATCCGGTAAGCGCGCTTATGACCGCCGCCTTTGTGCCGGGTGGTAATCCGGCCATGCGCGTTGCGTC

Clone Rv389
::::::::::::Rv389SP6.seq::::::::::::
GGCGGCTGCGTCGGCGAGATGATCGCCCGGTGCCACCCCGATCCGTGCCTCGGTCAGCGCCAACGTGCTTTCCGGTCC (SEQ ID NO. 537)

GGCGACCACCATGTCGCATGCGCCGAC

::::::::::::Rv389T7.seq::::::::::::
GCAATCGCCTTGGCGGTCGCCGGGTTGTCACCGGTGATCATCNCGGNGCGGATGCTCATNCGGCGCATTTCGTCNAAT (SEQ ID NO. 538)

CGTTCCCGTATGCCCACCTTGACGATGTCCTTCATATGGACCACGCCGATGGCCCNCGCGCTNCTG

Clone Rv38
::::::::::::Rv38SP6.seq::::::::::::
CCGGCTCGTATGTTGTGTGGAATTGTGAGCGGATAACAATTTCACACAGGAAACAGCTATGACCATGATTACGCCAAG (SEQ ID NO. 539)

CTATTTAGGTGACACTATAGAATACTCAAGCTTCCACATCGGTATGCCAAAGCATTGCGCCGCTATCGATTTCGCGCT

GGGTCGCCAAGGTGGACTTCTTGCTCAGCGACGAGATCCCGTGGTCGGATCCGCCGGCTGCGGCGGGCTGCGACCCTG

CATCTCGGCGGCACCCGTGACCAGATGGCGCGCGCCGAGGCAGACGTCGCGGCGGGACGCCACGCCGACTGGCCGATG

GTGCTGGCCGCGTGTCCGCACGTCGCCGACCCCGGCCGCATCGACGAAACCGGCCGCCGTCCGTTCTGGACCTATGCC

CACGTGCCGTCGGGGTCCACGCTCGACGCGACCGAGACCGT

::::::::::::Rv38T7.seq::::::::::::
CGCGTCCACCGCAGCGTGAGATTGGTGGCGCCATTCGTCGTGGTGTAGCTGCTGTTGGCGGCGTCGCCGTATTGTGCG (SEQ ID NO. 540)

GGCCAGCCTTGTGCGGGGGCCGCTTCTACCCACGAGTCGGCACTTCCGCAACCGCCCAGCTCGACCGCGATTACGGCG

GCCGCAACGGCCGCCGGAAGGCGTCTCGCAAGCGCCTTATCCTTTCGCAGGTTCCCAGATCCTTCCGCTACGTGGGTC

GCTCATCGGCGGGCCCGGCCGAATGAGTACAGGTGAGGGTAACCGCTACAAATGAAGTTGGTCAGTGCTGGCCAACTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TGTAATGGTTGCCCGGCTCGGGTCACCACGTACATTCTGGCAAGGCGGGCGAGATTCGGTTCCTCGCGTCCTTGGCCG

GTGGCGGTTCCCGGTTGTCCGTGGGCGTGTCGTGTACGTGGTGTAAGTGTCGTGAACTCCTCAGTTTGGGCT

Clone Rv390
::::::::::::Rv390SP6.seq::::::::::::
CTCAAGCTTGCGCTGGATCTGGCGGCTGAGCCTGTTCTTGGGCAACATGCCGAGGGATCGCCTTTTCCACCACGCGGT (SEQ ID NO. 541)

CGGGGTGGCGTTGCATTAGCTCACCGATGGTGCGCTTGTGCAGGCCGCCGGGATACCCCGAGTGCCGGTAAACCATCT

TGTGCTGCAGTTTGTCGCCGCTGATGGCGACCTTGTCGGCGTTGATCACNATGACNAAGTCACCGCCATCGACATTGG

GGGCGAACGTCGGCTTGTGCTTGCCGCGCAGCAGGTTGGCCGCCGCGACGGCAAGGCGGCCAANCACCACGTC

::::::::::::Rv390T7.seq::::::::::::
TTTGGGATGGGCAAAAAGGCGAAGCNCCGCGTGGCCACGAACGCCGGGAGGGACAATCTCGGGCGGCTAGGGCTTCTC (SEQ ID NO. 542)

GCGGGAAGGCCCGAACGTACGGCGTTTCAACACGTCGCGTCGCCCTCCGACCGCGAACATTCGGGGATGGCAGCAACC

TGGTAGCACCCTGGCCGGGCGATGATCTGCAGCGTCGCCGCGGGTAGTCGCCGCCCGGGCGGCTACAGTCTGAAACGC

GATGACCATCGATGTGTGGATGCAGCATCCGACGCAACGGTTCCTACACGGCGATATGTTCGCCTCGCTGCGCCCGTG

GACCGGTGGGTCTATCCCGGA

Clone Rv391
::::::::::::Rv391SP6.seq::::::::::::
CTCAAGCTTCGTCATAAGACCATGGTGCGCTTTCTTTCACCCGTCCANAGTCGGGGGCATCCGCACCGGCTCGCATCG (SEQ ID NO. 543)

CATCATCCTCCCACGACGGGCCGCTCATCAGCTTGGGCCATTTCAATGTACTTGATACCCCGCGCTGCGGGTAGGCCA

CTGCNACAATTCAAACACGGTGTCACACGGTGAATANTGTCNANATGGGCTCTGATCAACCGTCNCAAACCCGGTTTC

::::::::::::Rv391T7.seq::::::::::::
GAATTCTGCGTGCACCGCTATGGGTTGCAGCAGCGGCTGGCGCCGCACACCCCACTGGCCCGGGTGTTTTCGCCCCGA (SEQ ID NO. 544)

ACCCGGATCATGGTGAGCGAAAAGGAGATTCGCCTGTTCGATGCTGGGATTCGCCACCGCGAGGCCATCGACCGATTA

CTCGCCACCGGGGTGCGAGAGGTGCCGCAGTCCCGCTCCGTCGACGTCTCCGACGATCCATCCGGCTTCCGCCGTCGG

GTGGCGGTAGCCGTCGATGAAATCGCTGCCGGCCGCTACCACAAGGTGATTCTGTCCCGTTGTGTCGAAGTGCCTTTC

GCGATCGACTTTCCGTTGACCTACCGGCTGGGGCGTCTGCACAACACCCCGGTGAGGTCGTTTTTGTTGCAGTTGGGC

GGAATCCGTGCTCTGGGTTACAGCCCCGAACTCGTCNCGGCGGTGCGCGC

Clone Rv392
::::::::::::Rv392SP6.seq::::::::::::
GCAGTTGGGAATCGCTCTGCAGCAAACCANTATTCTGCGCGACGTTCGAGAGGACTNTTTGAATGGACGGATCTACCT (SEQ ID NO. 545)

GCCGCGCGACGAGCTGGACCGATTAGGCGTACNCCTCCGCCTGGACGACTCCGGGGCACTCGATGACCCCGACGGACG

GCTCGCGGCACTGCTGCGGTTCANTGCCNACCGCGCCGCANACTGGTATTCGCTGGGACTGCGGCTGATTCCACACCT

CGACCGCCGCAGCGCTGCCTGCTGTGCGGCCATGTCTGGCATCTACCGCCGTCNGCTCGCCTTGATCAGACCATCGCC

GGCGGTCGTCTACCATCGGCGAATCTCTCTGTTCGGGACTGAANAANGCCCAAGTGGCGGCGGCAGCACTGGNCTCTT

CGGTAACCTGCNGACCGCCCATTGGACCGCTACCG

::::::::::::Rv392T7.seq::::::::::::
TTGATCTGGACGTCTGAGACGGTGATCGGNCCGAACCTGAATTGTCCGGTAATGCCCAGCGCAGAAAGCANGGTGGTG (SEQ ID NO. 546)

GCCGGGGCGGTGAANCCGGCGTCGGCGGCACCGTCGAAGTCGATGTGGATTGCCGGAATGGGGATGTCCGGCACGGCG

AAGCCGTAGTTCGCTTGTCCCGTGAGGCCCANGTGGATGGGGGGAAGGATCGTGGTGTCCGGGATGATAATGGGGCCG

ATGCCGCCGGTTGAAGTCCAGTGGATCGGGAATTCGGGAATCGTGATGCCGACGTTCAGGCCGAACAGGCCCTCCAAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TTGCCTCGCCACNAGATGCCGTTGCTGAAGTTGCCCGACATGAGGGCGCCGGTGTCCACATTGCCCGAATTGGCGACG

CCGGTGTTGGC

Clone Rv393
::::::::::::Rv393SP6.seq::::::::::::
CACGTAGGCGCCGTCCATAAATNACTCCGCCGCGCTTCGCACATCCTCGTANCGATCCTTGGCGAGCAGGTCAACCGG (SEQ ID NO. 547)

GCGCTGCCCGTCNAGGAGCCGGTTTTTGGCGTGCAGCCACTGGCCGACACCTCGGGGGGTAAGCGAATCCGAGAGCAG

GAGGACNAGGTCACGAANCTGCGCCAGCCGGTCGTACCGCTCAGGGCGGATGTCGCCGGTCCGCCACCCGCGTACCGC

CCGATCGGACACCTGTATGACCGCGGCGACNTCGACCTGGGTGACGCCGAAGGGTTTCAGGGCATCNACNATCTCGCT

GGCCTCGACCGCCCGGTCCAGGGTGACCGCCATCGTGGTTCCTCCGCAACTTCCGGTTCTACTACCGTAAACGCTACC

G

::::::::::::Rv393T7.seq::::::::::::
CGGGGAACGGTCCTCGCACACCTGGTTCGTGTTGCGGGAATTACTCGGACANCAAAACGTCAAGAACTACGACGGCAG (SEQ ID NO. 548)

TNGGACAGAANACGGCTCCCTGGTGGGCGCCCCGATCGAGTTGGGAAGCTGATATGTGCTCTGGACCCAAGCAAGGAC

TGACATTGCCGGCCAGCGTCGACCTGGAAAAAGAAACGGTGATCACCGGCCGCGTAGTGGACGGTGACGGCCAGGCCG

TGGGCGGCGCGTTTCGTGCGGCTGCTGGGACNCCTCCGACGAGTTCACCGCCGGGAGGTCGTGGCGTCGGCCACCGGG

CGAATTTCCGGTTCTTCGCCGCGCCCCGGGATCCTGGGACCGCNGGCGCGCGCTGTT

Clone Rv396
::::::::::::Rv396SP6.seq::::::::::::
CTCAAGCTTTGTCCGACAAGCGTTCCCGGGCGGTCAGCAAGCGAACGTCGGTTGGCCCACTGCGGGTCGATATTGCCCG (SEQ ID NO. 549)

CCAGGGA

::::::::::::Rv396T7.seq::::::::::::
CGTCAGCACGGCGACGTCGCGNTACGCCGAGCAGTTACACAATCGCTCTGCAGCAAACCAATATTCTGCGCGACGTTC (SEQ ID NO. 550)

GAGAGGACTTCTTGATTGGACTG

Clone Rv39
::::::::::::Rv39SP6.seq::::::::::::
CTGCATCCGGCTCGTATGTTGTGTGGAATTGTGAGCGGATAACAATTTCACACAGGAAACAGCTATGACCATGATTAC (SEQ ID NO. 551)

GCCAAGCTATTTAGGTGACACTATAGAATACTCAAGCTTCGCGCAGCGGCGGGTTGACCCGGTTCACGCCGTCATAGC

TGGCCAATCTGGCATCGTCGATCANCATGTGGTGGGGGGTGACCTCGGCGGTGATCGAAATACCCTGGTCCTTATCCC

ATTTCAGGATTTCGACGGTGCCCGCGGCCGACGCGTGACAGATGTGCACCCGGGCGCCGGCGTCACGGGCCAGCAAGG

CGTCGCGGGCGACGATCGATTCCTCGGCGGCCCGCGGCCATCCCGCCAGGCCCAGCCGCGCCGCCATGGGTCCCTCGT

GCGCGACGGCGCCGACCGTCAGCCGGGGCTCCTCGGCGTGCTGGGCGATCAGCACGCCCAAACCGGTG

::::::::::::Rv39T7.seq::::::::::::
CCGACGCGCACTACGTGCTGGTGTCCACCCGCGACCCGCACCGGCACGAGCTACGCAGCTACCGCATCGTCGATGGCG (SEQ ID NO. 552)

CTGTCACCGAGGAACCTGTCAATGTCGTCGAGCAGTACTGAACCGTTCCGAGAAAGGCCAGCATGAACGTCACCGTAT

CCATTCCGACCATCCTGCGGCCCCACACCGGCGGCCAGAAGAGTGTCTCGGCCAGCGGCGATACCTTGGGTGCCGTCA

TCAGCGACCTGGAGGCCAGCTATTCGGGCATTTCCGAGCGCCTGATGGACCCGTCTTCCCCAAGGTTGTTGCACCGCT

TCGTGAACATCTACGTCAACGACGAAGACGTGCGGTTCTCCGGCGGCTTGGCCACCGCGATCGCTGACGGTGACTCGG

TCACCATCCTCCCCGCCGTGGCCGGTGGGTGAGCGGACACATGACACGATACGACTCACTGTTGCATGCCTTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv3
::::::::::::Rv3SP6.seq::::::::::::
TGCTTCCGGCTCGTATGTTGTGTGGAATTGTGAGCGGATAACAATTTCACACAGGAAACAGCTATGACCATGATTACG (SEQ ID NO. 553)

CCAAGCTATTTAGGTGACACTATAGAATACTCAAGCTTGCCGGGAGGGTGCATGGCCGACTCGGATTTACCCACCAAG

GGGCGCCAACGCGGTGTCCGCGCCGTCGAGCTGAACGTTGCTGCCCGCCTGGAGAACCTGGCGCTGCTGCGCACCCTG

GTCGGCGCCATCGGCACCTTCGAGGACCTGGATTTCGACGCCGTGGCCGACCTGAGGTTGGCGGTGGACGANGTGTGC

ACCCGGTTGATTCGCTCGGCCTTGCCGGATGCCACCCTGCGCCTGGTGGTCGATCCGCGAAAAGACGAAGTTGTGGTG

GAGGCTTCTGCTGCCTGCGACACCCACGACGTGGTGGCACGGGCAGCTTTAGCTGGCATTCCT

::::::::::::Rv3T7.seq::::::::::::
GGAAACACCGNCGCCGTCGTGGCCACCAACACCGCGACCAGCACCGTGACCCGGACCGGGGTGCCGCGCGAACCCGTC (SEQ ID NO. 554)

TTGGCCAATTGCCGCGGCACCAAGCCGTCGCGCGCCATGGCGAACAGCACGCGGCATTGCCCGAGCATCAACACCATC

ACCACCGTGGTAAGCCCGGCCAGCGCGCCGACGGAGATGATGCCGCTGGCCCAGTACACCCCGTTGGCCTGGAACGCG

GTGGCCAGATTTGCCGGCCCGCGGCCCGGTACGGTCCGCAGTTGGGTGTATGGAACCATGCCCGACAGCACCACCGAT

ACCGCGACGTAGAGAAGGGTCACGACCCCCAGCGACGCGAGAATCCCTCGAGGGACGTCTCGTTGAGGACGCTTGGTC

TCCTCGGCCATGGTGGCCACGATGTCAAACCCGATAAACGCGAAGAACACGATCGATGCCCGGCCAGCACGCCCTA

Clone Rv40
::::::::::::Rv40SP6.seq::::::::::::
CCTGCTTCCGGCTCGTATGTTGTGTGGAATTGTGAGCGGATAACAATTTCACACAGGAAACAGCTATGACCATGATTA (SEQ ID NO. 555)

CGCCAAGCTATTTAGGTGACACTATAGAATACTCAAGCTTGTCCTCGGGCGTGGCCTCGGCCAAGAAATCGTCGACGC

CGGCCTCCTGTGCAATCGCCTTGGCGGTCGCCGGGTTGTCACCGGTGATCATCACGGTGCGGATGCTCATTCGGCGCA

TTTCGTCGAAGCGTTCCCGTATGCCCACCTTGACGATGTCCTTCAGATGGACGACGCCGATGGCCCGCGCGCTGCTGT

TATCGGTCCATTCCGCAACGACTAGGGGTGTCCCCCCGCCGGAGCTGATGCCGTCGACAATGGCACCCACCTCCTCAG

TGGGGTGGCCACCGTGATCGCAAAACCACTTCATCACCGCAGCCGCGGCACCTTGCGGATCCGAACGGATGCGCTC

::::::::::::Rv40T7.seq::::::::::::
TTCGTTCGATGGCGCCGCCCCGGCTACGGTTTGACCTGTGGGTGTCGAATTGGGGTCAAATTCCGAGGTCGGCGCGCT (SEQ ID NO. 556)

AAGAGTGGTCATCCTGCACCGCCCGGGGGCCGAACTGCGCCGGCTCACACCGCGCAACACCGACCAGCTGCTGTTCGA

CGGCCTGCCCTGGGTATCCCGCGCGCATGACGAGCACGACGAATTCGCCGAGCTGCTGGCTTCCCGCGGTGCGGAAGT

GCTGTTGCTGTCGGACCTGTTGACTGAGGCACTACATCACAGCGGGGCCGCCCGCATGCAGGGGATCGCCGCTGCCGT

CGACGCACCGCGGCTGGGACTGCCGCTGGCGCAAGAACTTTCGGCCTACCTGCGTATCTCGACCCAAGCANGTTGGCG

CATGTGCTGACGCCGGCATGACTTCAACGAACTCCCNTCCGACACGCCGAACGAAGTGTCGTTGGTGTTGCGTATGC

Clone Rv412
::::::::::::Rv412SP6.seq::::::::::::
GCGGCGAGTGTGGTGGGTGCCGAACACGAATCCAACGACGCACTGGCGGAGAGATACCACTTGCTGTACTGGAAGCAC (SEQ ID NO. 557)

GTGCTGATGATCTCCCGTGGAATGTGCCTCGCCCCCGTCTATCGAAAACAGTGAGCATGCTGCG

::::::::::::Rv412T7.seq::::::::::::
CAACCGCGCTCGGCGCGTCTGGGCCTTCCGCCGGCTCCGCCGACAATTCTATCTCTGGATCAGCGGGGCTCTCCGGGC (SEQ ID NO. 558)

CGGCCTCCGCGAACTCAACAGGCCGCGCCTTCCGGCCGAAACATTCCCTAGCCATATATGATCGCACCTCGATACACG

ATCTGGCGGCAACACCGCAAAGCGTCCGACGGGCCCAACCTCCGCAATTCAGGTATCCGGG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv413
::::::::::::Rv413SP6.seq::::::::::::
GAAGGTCGGCGAAGGTGTGGCTGGMTGCCGATCACGAATCCAATGATGCAGTGGTCGGAAGATATTAGCCACTTGCTG (SEQ ID NO. 559)

TTCTGGAGACAGGTGCTGATGATCTCCCGTGGAATGTCCCTCGACTCCGTCTATCGAAATCTGTGAACA

::::::::::::Rv413T7.seq::::::::::::
TCCTGCGCTCTGGGCCATTCTCGGGTCTGCCGACAATTCTATCTCTGGATCTGTGGGGCTCTCTTGGCCGGCCTCNGC (SEQ ID NO. 560)

GATCTCTTCANGGCGCGCCTTCCGGCCGAAACATTCCCTATCCATATATGATCGCACCTCTATACACCGTTTGGCGGC

AACACCGCAAAGTGTCTGTCG

Clone Rv414
::::::::::::Rv414SP6.seq::::::::::::
AGCTTTACGCTGGCGTATCAGCGTTGGGGCCGCTGCCATTTCGGTCGCCCAACGCGTTGCCAGCTCCCTGCGCTGTCA (SEQ ID NO. 561)

GGGCTTGCGCGCCAAACTGGCCACCGCAACAAACTTGGCTGAGCTTGATC

::::::::::::Rv414T7.seq::::::::::::
CTCTATCTGGCGTCACATTCGCAATCTTTAGATTGCAGATATCGATAAAATCACCCGCGCGACAAGACCGCCATGTCA (SEQ ID NO. 562)

TCCTTTCGATGTTATTTCGCCGGCCTGGGGAAAGCGCAACGACGTTGCCTACACGTTCCGCCGT

Clone Rv415
::::::::::::Rv415SP6.seq::::::::::::
AGCTTTNCCTTGCATCTGCACCCCGATCCACGTCAGCCACGTCGGCGTTCTCCACCAAGAAGTTGCGGGCATTCTCCT (SEQ ID NO. 563)

TGCCCTGGCCGAGCTGCTCGCCCTCGTAGGTGAACCAGGCACCCGACTTGCGGATGAGGCCCTGATCCACACCCATGT

CGATCAGCGAGCCCTCCCTGCTGATTCCCTTGCCGTAGAGGATGTCGAACTCGGCCTGCTTGAAGGGGGGCGAACAGT

TGTGCACGACAACCCCTTCGGCGACGAGGGTGTGCAGTTCCTCGACCTCGAGGTCGAACGTTCGTGCCCGCCGCGTTG

GCAGCACTTCTCGGATCACGGAATAGCGGANTTCTTCCGCCAGCATGTCGTGCAGGAATTTGTCATCCAGGGCATCCG

CGAGCGCCTGCACGCG

::::::::::::Rv415T7.seq::::::::::::
ACTGTCNAGGGAATGCTTCGCAGCATCTACCTGCAGTCGCTTGTGCATAAGCGGACGGCCCNACCTGTTCGTGTTCCG (SEQ ID NO. 564)

GGACACCAGACGCGGGAGCACCGGCAGTACGGCGAAGGTTTGAGCGGAAGGAGTTGCGCAAATCGGGGCGCGCCCAAC

ACCCGTCCGCAAGACGCGGTCAACGACCTGTTTCAGGCGATCAGGGTCACCGACTCACCTGCACTGAGAACAAGCGAT

CTGCTGATCTGCCAGAAGATGGACATGAATGTCCACGGCAAGCCTGATGGCCTGCCGCTCTTCCGGGAATGTTTGGC

Clone Rv416
::::::::::::Rv416SP6.seq::::::::::::
TGAATTATGATCCCGACACAACTGCATCANTTTAGCCGCGTCGNGATGCTATCCGCCGACGGTTTGGANCNGGTCCGT (SEQ ID NO. 565)

GTCGTTCGTGTTGATCTCACCCGAAGTTGTGTCCGCCGCCGCCGGGGATCTAGCGAACGTGGGATCGACAATCAGCGC

CGCCAACAAGGCGGCAGCGGCTGCGACCACGCAGGTGCTGGCCGCGGGCGCCGATNAGGTGTCAGCGCGCATCGCGGC

GCTGTTTGGTATGTACGGCCTGNAATATCCGGCGATCAGTGCGCAAGTTGCCCGCGTATCACCANCAGTCCGTGCAG

::::::::::::Rv416T7.seq::::::::::::
AACGGGGACCNCAAGAAACCATTCAANAACGAGGGGTCGTCACCAACGTCGAAACCGACGGTTGCCAGCCGGCCCACG (SEQ ID NO. 566)

ATATTGCGTGCTCGAGGGTCCGCTGTACCCTCACCGAACGTGAGTCCCACACCGCGGAGGCGGGCGACTCTGGCGTCG

TTAGCAGCCGAGCTCAAGGTGTCCCGCACCACTGTCTCGAATGCTTTTAACCGACCGGATCAGCTCTCCGCCGATCTA

CGTGAACGAGTGCTTGCCACGGCCAAGCGACTGGGCTATGCCGGACCGGATCCGGTGGCGCGATCGTTGCGGACCCGC

AAAGCCGGTGCGGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv417
::::::::::::Rv417SP6.seq::::::::::::
AGCTTTGGAGCCNCNCCGANCCNCCGGTACGCCCCGCCACCGCCGTACCCGGCACCCGACCCCTTTGAGCCGTTCGCC (SEQ ID NO. 567)

GTGGCCGCGGTGGANCTGGCCGACGAGGGACTGATCGTGCTGGGCAAAGTGGTCGATGGCACGCTGGCCGCCGATCTG

AAGGTCGGCATGGAGATGGAGCTGACGACCATGCCGCTGTTCGCCGACNACGACGGTGTGCAGCGCATCGTCTACGCG

TGGCGGATCCCATCGCGCGCCGGCGACNATGCANAGCGCANCGATGCTGAGGAGCGGCGCCGATGAGGATGAGCGCGC

CGGAACCCGTTTACNTCCTGGGTGCCGGTATGCACCCGTGGGGGAAATGGGGTAATGACTTC

::::::::::::Rv417T7.seq::::::::::::
TTCTCNCATCGTTCGTACTNNGATGGGACGCTGCTGCCCGAGGCGATCCTGGCCAACCGGCTCTCGCCGGCGCTGACC (SEQ ID NO. 568)

TTCGGCGGGGCGAACCTGAACTTCTTTCCGATGGGCGCTTGGGCCAAACGTACCGGGGCTATCTTCATTCGGCGTCAG

ACGAAAGATATTCCCGTCTACCGCTTCGTATTACGTGCTTACGCCGCGCAGCTGGTGCAAAACCATGTCAACCTCACC

TGGTCGATCGAAGGGGGTCGGACCAGAACGGGCAAGCTACGGCCACCGGTGTTCGGGATCCTGCGTTACATCACCGAT

GCGGTCGACGAAATCGACGGTCCCGAAGTGTATTTGGTGCCGACCTCGATCGTGTACGAACAGCTGCACGAAGTGGAA

GCCATGACCACCGAAGCCTATGGCGCCGTGAA

Clone Rv418
::::::::::::Rv418SP6.seq::::::::::::
TTCTTCCGGGTACCGCTGATCGGCGGCACCATCACGCACCCGGTGCAGGGCGAGGCGGCCGCCGGTGTGGTGTTGCTA (SEQ ID NO. 569)

CGGCCGGCCAGCCCGGGTACCGGTGTGATCGCCGGTGGTGCGGCCCGCGCGGTGCTGGAATGTGCGGGGGTGCACGAC

ATCTTGGCCAAGTCGCTGGGCAGTGACAACGCGATCAATGTGGTGCACGCCACCGTGGCCGCGCTCAAGCTGCTGCAC

CGTCCGGAGGAGGTGGCGGCGCGCCGCGGTTTGCCAATAGAAGACGTCCCCCCGGCCGGGATGCTG

::::::::::::Rv418T7.seq::::::::::::
GTCGAAAGTGACCATCTCTACCTTGAGTGCCATACCGCCCGACCCTATGCCTCGGATAGCTCGGCGGAAAGAAACGCT (SEQ ID NO. 570)

TGCAGTGCCGCCGAATAGGCGGCTACGTCGTGAGCGCCCATCAACTCTCGCGCGGAGTGCATCGCCAGCTGGGCGGCG

CCGACGTCGACCGTGGGGATTCCGGTGCGCGCCGCGGCCAACGGCCCGATCGTCGACCCGCACGGCAGATCGGCGCGA

TGTTCGTAACGCTGCATAGGCACTCCCGCGCGCTGGCAGGCCAGTTGCGAAACGCCCCCGCCGGGTGCCTTCCGTCGG

TTGGCTTTACCGCAAATTTGGGGTTGCCCCT

Clone Rv419
::::::::::::Rv419SP6.seq::::::::::::
AAAGCCACGGAAACGATTGCCTACTGCCGAATCGGGGAACGGTCCTCGCACACCTGGTTCGTGTTGCGGGAATTACTC (SEQ ID NO. 571)

GGACACCAAAACGTCAAGAACTACGACGGCAGTTGGACAGAATACGGCTCCCTGGTGGGCGCCCCGATCGAGTTGGGA

AACTGATATGTGCTCTGGACCCAAGCAAGGACTGACATTGCCGGCCAGCGTCTACCTGGAAAAA

::::::::::::Rv419T7.seq::::::::::::
TTTCGCCACCGCNAGGTCGTGCGCGTTCCAGAAAAGCGTGGTTTCGCCGGGCGCGAGGATTCGACGGTCCAACTGACC (SEQ ID NO. 572)

AGCCGGTCCCGCCACCCGTTAGGCAGGATCGCGGTGTCTATATGTTCGCCCTCGGCATAAACGCCATTGCTGCGGTGA

AAATCGGACATCTCGCCGATTGCCACGTCTACATGATCCGCTTTGTCCCGCGCCGGGTCGTTGACAAACGCGATGTCN

GCCTCCTGGGAAGCGGTGGC

Clone Rv41
::::::::::::Rv41SP6.seq::::::::::::
TCGCCAAGTGGATTCGTGCTCACCNACGAGATCCGTGGTCGGATCCGCNGCTGCGGCGGGCTGCGACCCTGCATCTCG (SEQ ID NO. 573)

GCGGCACCCGTGACCAAATGGCGCGCGCCGAAGCAGACGTCTCGGCGGGACGCCACGCCGACTGGCCGATGGTGCTGG

CCGCGTGTCCGCNCGTCNCCGACCCCGGCCGCATCNACCAAACCGGCCGCCGTCCGTTCTGGACCTATCCCACGTGCC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

NTCGGGGTCCACGCTCGACGCGACCGANAACGTAACCAGCGTCCTCGANCGGTTCGCCCCCGGCTTCCGTGACATCGT

GGTGGCGGCCGCGCCGT

::::::::::::Rv41T7.seq::::::::::::
GTACCGTCACCATGATCGCCCCCATCCGCATCGGTGAGCTGATAGATCCCAGCCGGTTTCGCCAACCCCGGAGCGATC (SEQ ID NO. 574)

TTGGCGCGCTGCTNGTNGTCNCTGANACNTAGCCACCAACAGAGCCCGGTGTGCGACAAGANGACTGATCGGATCTCT

CCGGACACNTCGAGGGGGTCWTCAGGAGNCCGGGCGCCACCCCGAGGTAAGCCTCCGCCCAGCCTCACACCGCGACCG

GGTATCNCAAGTCGCGCAATAANCCCACCACCTCCTCGGACCCCACGTTGTATGCGGCTGGGT

Clone Rv42
::::::::::::Rv42SP6.seq::::::::::::
ATACTCAAGCTTAGACCTCACTGATGTGGCGGGACGCGGGAGATAACCGCGGTTCGAGCCGTTCAACAGTGGTGGTTC (SEQ ID NO. 575)

CCACACCAGTTGTTTGCCTTTGCGAAGTAAAGCGATTCGATTTGCTCGAAAAGAGGGCTGGCTGCTCGTGAGGGACAT

CCATGGCCGATACCTCAGCGATCTCAACGGTCAAGCGACTGCATGTTTGGCGCAAGGTATCGCTAAGCATAGGTTCGT

GACGGATTTGACAGCAAGAGCTTTCCAAAGATTGCTGTCCACATANTGATTCGCATCTCTACACCTCTTCGCCGGTGC

TGTCAAGAGCCATTCGAATCAGTTATCTCGCTCGTGCTTGGAANAAATTTTCCCAGCCTGCGTTGGACAAACCGCGTC

GCCAAAGCGGT

::::::::::::Rv42T7.seq::::::::::::
AGCTTCCCGAGAAACAGTGCATTCCCTAAGCAGCCCGTTGTCACGCCGATGAGTGAAGAGTGCACGCAATCGCCGGAA (SEQ ID NO. 576)

TCCGGCAAAGCCCTGCACAAGCGAAATCAACCCGGAGGCTGACAAGGCAACGTCGGTGATCCGTACCGCCTGGTTGGA

CAAACGGCAGAAGGCGGCCTCGTCCGGTCCATCTACGCCGAGCACACTGGTGATAGCGCGCATCGGCATCGGTGCCGC

CACGGTGGAGACGACGTCCGCGGGCGTCTGGGTCAGTAACCCGCCGACCAGTTCTCGGGCAAGCTGGTCGACCATCGG

GCGCCACGTCTCCAACGCGCCACGCGCCATACCTGGTGCCAGTTGCTTGCGCATCCGGGTGTGCGCCGGCGGATCGGA

CGTCGCAGAAACGCAGCCACCCCGTGAGAAGTGACCCACGGCGCTGGACACGTGTCTGGTTAC

Clone Rv43
::::::::::::Rv43SP6.seq::::::::::::
CGGCCGGGATGTGCGCAATGGCAGGTTGTCGCCCGGCTTGATGTCGGCGTTAGCGCCGGATTCCACCACATCCCCTTG (SEQ ID NO. 577)

CGAAAGTCCGTTGGGTGCAATGATGTANCGCTTCTCCCCATCGAGATAGTGGAGCAACGCAATCCGTGCGGTACGGTT

CGGGTCGTACTCGATGTGCGCGACCTTGGCGTTGACACCATCTTTGTCATGGCGGCGAAAGTCGATCATCCGGTAAGC

GCGCTTATGACCGCCGCCTTTGTGCCNGGTGGTAATCCGGCCATGCGCGTTGCGTCCACCGCGACCGTGCAGCGGGCG

CACCAGCGACNTCTCCGGGGTTGACCGGGTGATCTCGGCGAAATCAGATACGCTGGCGCCGCGACGACCAGGCGTCGT

GGGCTTGTACTTGCGAATTGCCATGGTCTAATCAGGTCTTTCTCTCACCTCTCGTCGCCGGGCTAGGGCGCATTGCCT

GCTCCT

::::::::::::Rv43T7.seq::::::::::::
TAGCGGTGTAACCAACTCCCGGGTCACCACCCGCAAACCTCTTGCGGCAACAGCACCGTCGACGCGTCAACCGGGCTG (SEQ ID NO. 578)

CCCGGAATCCTGTGGATGGGCATCGAGTGCATGGTCACGACGTCCCCGACGCGGCCGGTGGCAACGACAAGTGGCCCG

GATGCACCACAAATGACGGCCGCACACCGGTGGGGACGGCCAGCACGAGAGCCGTGTCGCCGAAGTCGACGCTAATGC

CGTAGGCATTGGCCGTCACAACAGGCGACGCCCCGCGTACCACCGAGTCCACGGNGGTTGGGCGGTCTCCTCGGCCAA

CCAGGCGTGAACCCGGCGGATCCGAATGCAGCAAGACCCGTGGGC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv44
::::::::::::Rv44-2ndSP6.seq::::::::::::
CCATTGGTCGGTGTGCGCATACCANTACNACGCGCCGGGCACCTGACGCGGCGGCCGCAACCATTCGGTGGCCATCGC (SEQ ID NO. 579)

CATCGTCTGCCACCCGGTCAACGGACGCACCTTCTCCTGGCCGACCTAGTGCGCCCACCCGCCGCCGTTGCGTCCCAT

CGATCCGGTCAACATGAGCAGCGCCAACACCGAGCGGTACATGACATCTGCTGTGGAACCAGTGACANATTCCGCCGC

CCATGATGATCNTCGACCGTCCTCCGGATTCGGTC

::::::::::::Rv44-2ndT7.seq::::::::::::
GCCGGCCTGGTCAAAGGGGCGTCCGAAGGANCCGGGCTGGGTAAGAAGTTCCTGGCTCATATCCGCGAATGCGACGCC (SEQ ID NO. 580)

ATTTGTCAGGTGGTGCGGGTGTTCGTCGACGACNACGTGACTCATGTCACCGGACGGGTCGATCCCCAGTCCGACATT

GAGGTCGTCGAGACCGAGCTGATCCTGGCAGATCTGCAAACCCTGGAGCGGGCCACGGGCCGGCTGGAGAANGAAGCN

CGCACCAACAAGGCGCGCAAGCCGGTCTACGACCCGGC

Clone Rv45
::::::::::::Rv45SP6.seq::::::::::::
GATCCACTGACCACGATGACATATCGAAATGCTCGACGATTCCGATGGCGATCAAGGCCACGATGCCCTGGCCGTTGG (SEQ ID NO. 581)

GCGGTATCTGGTGGATGGTGTACCCGCGGTAGGTTCCCGTGATCGTGTCGACCCAGTCCACGCGATGGGCGGCGAGGT

CGTCGGCACGCATCACCCCGCCGTNTGCCGCCGAGTGCGCCTCGAGTTTGGCGGCCAGCTCTCCCCGGTAGAACTCTC

ACCGTTGGTCGCCGCGATCTTCTCTANCGTCGCCGCGTGGTCAGGAAAGGTAAACAGCTCACCGGGTTTCGGCGCTCG

TCCGCCGGGCATGAACGCATCTGCGAATCCGGGCTGGGATGCGAACAACGGACCTGTGCCG

::::::::::::Rv45T7.seq::::::::::::
TCTACTGCCGAATCGGGGAACGGTCCTCGCCCACCNGGTTCGTGTTGCCGGAATTACTCAGGACACCGAAACGTCGAG (SEQ ID NO. 582)

AACTACGAGCGGAGTTGGACANAATACCGCTCCCNGGTGGGCGCCCCCATCGANTTGGGAAGCNGAAATCTGCTCTGG

ACCCCACCCAAGAATGACATTGCCGGCCGCCCTCCAACTGGAAATAGAAACNGTGATCACCCGCCGCGTTCTTGGAAG

GAATGGCATGCCCTGGGCCGGGCGTTCCTTCCGCTGCCGGACTCCTCCCACCAATTCACCGCCGAAGGCGTCCCGTCT

GC

Clone Rv46
::::::::::::Rv46SP6.seq::::::::::::
ATACTCAAGCTTCTGTCACCGAAATCCCGCATGGGATAACGGGTTTAGATTTCGACAACGGGACCGTGTTTCTCAACA (SEQ ID NO. 583)

AGCCGGTCATCAGCTGGGCCGGCGACAACGGTATCTACTTCACCCGCTTTCGCCCGT

::::::::::::Rv46T7.seq::::::::::::
CTGGCTCAAGCGCTCGGCGCGCAGGTGAACTCGGACCGGCTCGACGTCGCCGAACGCGAGGCGGTGCTGGCCCACGCC (SEQ ID NO. 584)

GACGCCGTCGTCGCACATATCGGCACCGTGCACAAGTCTACAACAACGCCGGCATCGCGTACAACGGCAACGTCGACA

AGTCGGAGTTCAAGGACATCGAGCGCATCATCGACGTCGACTTCTGGGGCGTCCTCCACGGGCCC

Clone Rv47
::::::::::::Rv47SP6.seq::::::::::::
CCGCCCTCCGCATTATGGGTCAAGAACCATCGGGTCGGACTTCTGGGCTTCCAACGCTCGCGCCGTCCCN (SEQ ID NO. 585)

::::::::::::Rv47T7.seq::::::::::::
CCGTGGCACTGTCAGACATATGCGCCGCTCCTCCTCATCGCTGCGCTCGGCATCGTCGCCGGCGGTCATGGCGTCACC (SEQ ID NO. 586)

CTACCCAAGCCGAACGCGAAACGAGAACGTGTTCCATTATTAGGGTGTGAGCACCAATACCAGATTGCTCACCAGGAA

CTCACGCAGCACCGGGACGGATGTCGGCCACCACGCCCATCTGGGGTGGTAGCGGGGAAATACCGCTAACGCGGCTCC

GGTGCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv48
::::::::::::Rv48SP6.seq::::::::::::
TACTCAAGCTTGTCCAAATATCGAAGCGTCGGGTCGCGAGGCTCGGTCGGCAGCTCCAGCAAAACCCGCTCCACCCCT (SEQ ID NO. 587)

AGATGCCGGTATCCCTCAAGGTCTTTATCCGCCGCTTCACCCCACTGGCACACGGTCACCGGCACGTCGCCCCCGGCC

ATGGCGCGCAACCGCTGAAGCGGACCCGACAGCCGCTGCGGTGATGGACTGATCGCGATCCACCCGGCATTGAGCCGG

GCTATCCGCGGGAAGTTCGCCGGTCCCCCGCCCACATACAGCGGAGGATAGGGCTTTGTCACCGGCTTCGGCCAGCAG

TAGATCGGATCGAAGTCCACATATGTCCCATGGAATTCCGCCTGCTCCTGCGTTCAGATCTCGATTATCGCGCGCAAC

CGCTCATCGATCACACGTCCGCGCACCGCAGGGTCCACACCATGGTTGGCGACTTCTTCGCGCAACCAGCCACACCCA

CGCCGAAACGAAACCGTCCCTGCG

::::::::::::Rv48T7.seq::::::::::::
CAGGCATGCAAGCTTGGCCAACTCCTCATCGGACTTGAAGGTGCCGTCCTCGTTGGCGGCCCTGCTCCACGGCACGTT (SEQ ID NO. 588)

GATGGCACCAGGAATGTGTCCGGGCCGCTGGCTTTGTTCCTGCGGCAGGTGCGCGGGGGCCAGGATCTTGCCGGAGAA

CTCGTCGGGAGAGCGCACGTCGATGAGGTTCTTGACGTTGATGGCCGCCAGGACCTCGTCGCGGAATGCCCGAATCGT

GTTATCCGGCGGGGANGCGGTGTAGGAAGTCACCGGCCGGCTGACCGGGTCGCTGGACAGCGGGCGTCCGTCGAGCTC

C

Clone Rv49
::::::::::::Rv49SP6.seq::::::::::::
ATACTCAAGCTTCAAAACAGGCCTGTTGTGGGCGCACCCGGCTCGCCGAGTTCTGCACGCACCGCCTCAAGTGCGGCC (SEQ ID NO. 589)

CGCACCGCCGGCATCTCCCGGTCACGCAGGGCCGCGGCCCGCGCCGCAGCGACGGCGTGTTCGCGCAGTTCGCCGTCA

ATGATGCTGACCTGATCGGCCACCCGGGCGGTCTCGGCGTCGTCCCGTTCACTAATCGCGGTGCTCAGCAGCGTCTCG

ACAGCCACCACCCGAGTGGAGACCAGATGCNCCACCACGGACCGCAGCGATGCCAGTCACCTCACCCGTCC

::::::::::::Rv49T7.seq::::::::::::
CAGGCATGCAAGCTTTGCAGTTGCTGACTAATGTCGGCCAACGTCACCACAATCGCGATGAATTCAATCATGCCGCCC (SEQ ID NO. 590)

AGGGCGGCCAACCCAATGGTGGCCGCGAGCGGCAGCTCGATCGCAGCGCGGAGGTTGCCGGCCGCCAGTTGATTCACG

AACAGGGTGAGGTCATAGGCGCGCAGGATAGTGACGAAGGCAAGACCTAGATCTGCCGTCGGAAGAAGAATCGAGTAT

CCGGTCGACACAACGGAAGCGAAAGTGTCCGCGATGTTGATGAGCGTCGCCGGTTGTGGCGGCGGTGGCGGCGGTAGC

ACCGTCCGCACATACCGCGGGAACGCGGGCATCCGAATTTGGGGCAGGGTGTTCAAGGCGGCTGGCAACTCACCATGA

ATCT

Clone Rv4
::::::::::::Rv4SP6.seq::::::::::::
CCGGCTCGTATGTTGTGTGGAATTGTGACCGGATAACAATTTCACACAGGAAACAGCTATGACCATGATTACGCCAAG (SEQ ID NO. 591)

CTATTTAGGTGACACTATAGAATACTCAAGCTTGGCCGCAGGGCCGAGTCGATTGGTCGCGGTCGCCTCGACAGTTAG

CTTATGCAATGCTAACTTCGGGGCAAAGTTCAGGCGGATCGGCCGATGCCGGGCGTAGGTGAAGGAGACAGCGGAGGC

GTGGAGCGTGATGACATTGGCATGGTGGCCGCTTCCCCCGTCGCGTCTCGGGTAAATGGCAAGGTAGACGCTGACGTC

GTCGGTCGATTTGCCACCTGCTGCCGTGCCCTGGGCATCGCGGTTTACCAGCGTAAACGTCCGCCGGACCTGGCTGCC

GCCCGGTCTGGTTTCGCCGCGCTGACCCGCGTCGCCCATGACAGTGCGACCCTGNACCGGGCTGGCC

::::::::::::Rv4T7.seq::::::::::::
GTGTGCTGTCAATTCAGAGCTGAGCCTGATGCACTCAACTTACTGAGCATGCTAACGCTGGTCGTGCGGGTCTTGTTC (SEQ ID NO. 592)

CCGCGTGTCGGCAGGGCACACGCTCGGGGCGTAGCTGGGAGAGGCCCCGGTCAAGCCCGGAGAGCAGTGCTCAGTCCC

CCAGCTTGACCGACTTTCGATGAGAACGCGCTTCTCGCCGTATTGAACTGGCGTGCTGACGGTCGCTGAGCAGCGCTC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GCCGAGTGCGGCCGCTGATTCTTTCATCGAGCCAGGAGGCGCATTCGTGTTCGGCCGCCTGCGGGTCGGCCCCATCGT

CGACGCGATCCGTCACCCACTCCTCGATCAGGTCTGCCTCATCGAACGGGCCAACGGTGCTGTCGGAGTAAGTGTGCG

TGGGCACGCGAGCCGGGTGCTGTGGTACACCCACCGTTGCATGAACAA

Clone Rv50
::::::::::::Rv50SP6.seq::::::::::::
ATACTCAAGCTTCACCAGGCGCCGGCGGGCCGCGGCGCCAAGCCAGGCAGCCGCGCTCGGCGCGTCGGGGCCTTCCGC (SEQ ID NO. 593)

CGGCTCGGCCGACAGTTCGATCTCTGGATCGGCGGGGCTCTCCGGGCCGGCCTCGGCGACCTCAGCGGGCCGCGCCTT

CCGGCCGAACCATTCCCTAGCCATAGATAACCGCACCTCAATGCACGGTTTGGCGGCAACCCGG

::::::::::::Rv50T7.seq::::::::::::
AGCTTCCGTCACGACCCGCCCTCGCCGGTGCCGGCGCCATCGGTCATCGGATCTCATGACGACGTCACGTAGGCCCGC (SEQ ID NO. 594)

TAGCCGCGAGCGGGCGCGGTCAACTGGCGAGGCGGCGGCGACGTGACTGAGCTGGCCGAGCTGGACCGGTTCACCGCG

GAACTACCGTTCTCGCTCGACGACTTTCAGCAGCGGGCTTGCAGCGCGCTGGAACGCGGCCACGGTGTTGCTGGTGTG

CGCGCCGACCGGCGCTGGCAAGACGGTGGTCG

Clone Rv51
::::::::::::Rv51SP6.seq::::::::::::
ATACTCAAGCTTGCCGGGACCGCGGAACAGAACCGGCGGTTCCTACCGCGGTGTGCGGCCGGCGCGATATCGGCCTCC (SEQ ID NO. 595)

CGACTAACCGAACCCGATGTGGGCTCC

::::::::::::Rv51T7.seq::::::::::::
ACGTTGGCTCTGCCGGAACGTATTTCCAGCGGCACGCATTCGGCGTGGGTGCCGGGCGCCGAGTTGCGTCGCTGGGAT (SEQ ID NO. 596)

CACGCAGCAGTCGCCGGCGGCTGCCGTCGGGCTATGAATTGCACCGAGCCGGAAAATCCNCAC

Clone Rv52
::::::::::::Rv52SP6.seq::::::::::::
ATACTCAAGCTTGTCGTATTCCGTGGCACTGTCAGACATATGCGCCGCTCCTCCTCATCGCTGCGCTCGGCATCGTCG (SEQ ID NO. 597)

CCGGCGGTCATGGCGTCACCCTACCCAAGCCGAACGCGAAACGAGAACGTGTTCCATTATTAGGGTCTGAGCACCAAT

ACCAGATTGCTCACCAGGAACTCACGCAGCACCGGGACGGATGTCAGCCACCACCCCCATCTGGGGTGGTAGCGGGGA

::::::::::::Rv52T7.seq::::::::::::
CGTTGGTAGCCCGATATGCATAGTGTATCTTACTGAACATGATTTCCATTATGGAGCCCGGGGTGCCGGCAGCGCGAA (SEQ ID NO. 598)

CGGTGCGCCGTCAGACGCGGGCGGCACTGACCAGGGTGTTGCGGGCGAACATCGGCCCGGCTTCGGATTCCGGTCCGG

GTACCGGGCGACCCACCGCTTCGAGGTA

Clone Rv53
::::::::::::Rv53SP6.seq::::::::::::
ATACTCAAGCTTGGCCAACTCCTCATCGGACTTGAAGGTGCCGTCCTCGTTGGCGGCCCTCCTCCACGGCACGTTGAT (SEQ ID NO. 599)

GGCACCAGGAATGTGTCCGGGCCGCTGGCTTTGTTCCTGCGGCAGGTGCGCGGGGGCCATGATCTTGCCGGAAAACTC

GTCGGGAGAGCGCACGTCGATGAGGTTCTTGACGTTGATGGCCGCCAGGACCTCGTCGCGGAATGCCCGAATCGTGTT

ATCCGGCGGGGAGGCGGTGTATGAGGTCACCGGCCGGCTGACCGGGTCGCTGGACACCGGGCGTCCGTCCAGCTCCCA

CTTCTTGCGGGCGCCGTCCAACNACTTGACTTCTCCTGG

::::::::::::Rv53T7.seq::::::::::::
ATATCTTAAGCGTCGGGTCCCGAGGCTCGGTCGGCAGCTCCAGCAAAACCCGCTCCACCCCTAGATGCCGGTATCCCT (SEQ ID NO. 600)

CAAGGTCTTTAGCCGCCGCTTCACCCCACTGGCACACGGTCACCGGCACGTCGCCCCCGGCCATGGCGCGCAACCGCT

GAAGCGGACCCGACAGCCGCTGCGGTGATGGACTGATCGCGATCCACCCGGCATTGAGCCGGGCTATCCGCGGGAAGT

TCGCCGGTCCCCCGCCCACATACAGCGGAGGATAGGGCTTTGTCACCGGCTTCGGCCAGCAGTAGATCGGATCGAAGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CCACATATGTCCCATGGAATTCCGCCTGCTCCTGCGTCCAGATCTCGATTATCGCGCGCAACCGCTCATCGATCACAC

GTCCGCGCACCGCAGGGTCCACACCATGGTTGGCGACTTCTTCGCGCA

Clone Rv54
::::::::::::Rv54SP6.seq::::::::::::
ATACTCAAGCTTGTCGCGGTAAACCCGCAGCAGGGCGGTGGGTGCGGTGTCAAAAACAACCACACTTCTTTGCGGTTC (SEQ ID NO. 601)

GGTGATCTCGACACCGGCCGCGAGCCGACCACCATGCGCGCGTAAATCGATCAGATCAGCGTCGGCTATCGCCTGGGT

GCCGCCCACCGGAATCGGCCAGCCGACCGAATGGGCCAGCGTTGCCAGCATCAGTCCGGCGCCGGCCGACACCAGTGA

CGGCAACGGTGAAATCGCGTGGGCGGCAACGCCGGTGAACAACGCGCGGGCATCCTCGCCCGCCAGCGACCGCCAGGC

AGGGGTGCCCTGGGCCAGCATCCGCAGCCCGAGACGCAGGACCGAGCCCAGTGCAGTAGGCAAAGACCGCTTGTCGGA

GACATGAACTCCACGACCGT

::::::::::::Rv54T7.seq::::::::::::
AGCTTATTGAACCGCGGGTCGCAGGCAAAGTGGACCTCATAACGACTCGGGTCCAGCGACCGCGCCAACACGAACGGC (SEQ ID NO. 602)

CGGACGACGTGGGCCAGGGTCGCGGCCTCCCCTACAAACAGGATCCGTTGCCTGCGAGCGACAGGCTCCGGTGCGGCG

TTGGGCGCCGTGCTCGTCCCAGCGTCCGGTCCCGGGTCGCCGGCGACGCTTGTTTCCTCCATACTCGCCCCCTAATCT

CGAGGCAGCCCGTACCCGCAGGCAACCTCCCAAAAATGCAATCCCCCAAAATGCAATGCGTCGAGCTATTTCTCACAC

CGACCGCTAGTTGCGGATCAGAAATCCGTTGGGCGCGGAAGTCCAGCCGAATTTGTTCTCCCGCTCCGCATCATGCTT

GTAATCGTTTGGAAATTCATCCTCATATGCCTCGATCGCTTCATAGGGTCCAGGCCAAACCGGGCA

Clone Rv55
::::::::::::Rv55SP6.seq::::::::::::
CTTCCGGCTCGTATGTTGTGTGGAATTGTGAGCGGATAACAATTTCACACAGGAAACAGCTATGACCATGATTACGCC (SEQ ID NO. 603)

AAGCTATTTAGGTGACACTATAGAATACTCAAGCTTGGCCACCTCGCGGTGTGTGGTGGAACCCATCTGAGCAGTGTG

CCAAACCGGGGCAGACAGCTCCCAATTGACGTGAGCCCGCTCACTTGCTGGGTAAGCGTCG

::::::::::::Rv55T7.seq::::::::::::
TAGCGCCCCCTCCCGGGCGGAGCTCCACGGCGTGGATCAAGGTACCGGCCGGGATGTTGCGCAATGGCAGGTTGTTGC (SEQ ID NO. 604)

CCGGCTTGATGTCGGCGTTAGCGCCGGATTCCACCACATCCCCTTGCGAAAGTCCGTTGGGTGCAATGATGTAGCGCT

TCTCCCCATCGAGATAGTGGAGCAACGCAATCCGTGCGGTACGGTTCGGGTCGTACTCGATGTGCGCGACCTTGGCGT

TGACACCATCTTTGTCATTGCGGCGAAAGTCGATCATCCGGTAAGCGCGCTTATGACCGCCGCCTTTGTGCCGGGTGG

TAATCCGGCCATGCGCGTTGCGTCCACCGCGACCGTGCAGCGGGCGCACCAGCGACTTCTCCGGGGTTGACCGGGTGA

TCTCGGCGAAATCAGATACGCTGGCGCCGCGACGACCAAGCGTCGTGGGCTTGTTCTTGCGAATTGCATGTCTAATCA

GGTCTTTCTC

Clone Rv56
::::::::::::Rv56SP6.seq::::::::::::
TGAAACTATATAATACTCAAGCTTGCCAAAGAAGACCTCGTCGACCAAGCAGGACGCGACCGTCGAGGTGGCGATCCG (SEQ ID NO. 605)

GCTTGGCGTCGACCCGCGTAAGGCAAACCAGATGGTTCGCGGCACGGTCAACCTGCCACACGGCACTGGTAAGACTGC

CCGCGTCGCGGTATTCGCGGTTGGTGAAAAGGCCGATGCTGCCGTTGCCGCGGGGGCGGATGTTGTCGGGAGTGACGA

TCTGATCGAAAGGATTCAGGGCGGCTGGCTGGAATTCGATGCCGCGATCGCGACACCGGATCAGATGGCCAAAGTCGG

TCGCATCGCTCGGGTGCTGGGTCCGCGCGGCCTGATGCCCAACCCGAAAACCGGCACCGTCACCGCCGACGTCGCCAA

GGCCGTCGCGGACATCAAGGGCGGCAAGATCAACTTCCGGGTTGACAAGCAGGCCAACCTGCACTTCTC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

::::::::::::Rv56T7.seq::::::::::::
GCTGAGCTCCACGGCGTGGATCAAGGTACCGGCCGGGATGTTGCGCAATGGCAGGTTGTTGCCCGGCTTGATGTCGGC (SEQ ID NO. 606)

GTTAGCGCCGGATTCCACCACATCCCCTTGCGAAAGTCCGTTGGGTGCAATGATGTAGCGCTTCTCCCCATCGAGATA

GTGGAGCAACGCAATCCGTGCGGTACGGTTCGGGTCGTACTCGATGTGCGCGACCTTGGCGTTGACACCATCTTTGTC

ATTGCGGCGAAAGTCGATCATCCGGTAAGCGCGCTTATGACCGCCGCCTTTGTGCCGGGTGGTAATCCGGCCATGCGC

GTTGCGTCCACCGCGACCGTGCAGCGGGCGCACCAGCGACTTCTCCGGGGTTGACCGGGTGATCTCGGCGAAATCAGA

TACGCTGGCGCCGCGACGACCAGGCGTCGTGGGCTTGTACTTGCGAATTGCCATGTCTAATCAGGTCTTTCTCT

Clone Rv57
::::::::::::Rv57SP6.seq::::::::::::
ATACTCAAGCTTGTTGGTGACCTCGCCGGCGAACAGTTCTCGCACGATTTCCGGATTAGCGGGACTGGTCACCAGTTG (SEQ ID NO. 667)

GGTATGCGGGAAGGCGCTGACGTTCGCCGCGATTAGCTGTTTGATGGACGCGGCGGTGATGTCCTGATCACGGAACTG

GCTGTAATAGCCCAGGGTCGCCACGCTTCCATCCGGGCCCGGACCCGGC

::::::::::::Rv57T7.seq::::::::::::
GATGATCGCCGGTGCCACCCCGATCCGTGCCTCGGTCAGCGCGAACGTGCTTTCCGGTCCGGCGACCACCATGTCGCA (SEQ ID NO. 608)

CGCACCGACCAGGCCGAACCCGCCGGCCCGCACATGCCCGTTGATGGCGCCGACCACCGGCAGCGGCGACTCGACGAT

GGCGCGCAACAGCGCCGTCATTTCCCGCGCCCGCGCCACCGCCATCCGGTACGGATCACCACCACCTCCGCCGGCCTC

GCTGAGGTCC

Clone Rv58
::::::::::::Rv58SP6.seq::::::::::::
ATACTCAAGCTTGCCGCAATCGAAACCAACCTGTTTGTGCCGCAAGAAATTACGCCGTGGCCCGGCGCCGATCAAGAA (SEQ ID NO. 609)

ACGCCCCGGCGCGCGGCGGTGTCGTCGTATGGCATGACGGGCACCAATGTGCACGCCATTGTCGAGCAGGCACCGGTG

CCAGCCCCCGAATCCGGTGCACCAGGCGACACCCCGGCCACACCCGGTATCGACGGCGCGCTGCTGTTCGCGCTGTCG

GCCAGCTCGCAGGACGCGCTGCGGCAAACCGCCGCGCGGCTGGCCGATTGGGTCT

::::::::::::Rv58T7.seq::::::::::::
TTGGCGGGTTGGCCACANCANCCCGCCGGTGACGGCGACGATGCTGGGCTGGTTGCGGCCCTGCGCCACCGCGGCTTG (SEQ ID NO. 610)

CATGCTGGTTGGCTGTCTTGGGACGATCCCGAAATAGTCCACGCGGATCTGGTGATTTTGCGGGCTACCCGCGATTAC

CCCGCGCGGCTCGACGAGTTTTTGGCCTGGACTACCCGCGTGGCCAATCTGCTGAACTCGCGGCCGGTGGTGGCCTGG

AATGTCCANCGCCGTTCACCTACGTGACCTTGATGGGATCCGGGGGNT

Clone Rv59
::::::::::::Rv59SP6.seq::::::::::::
NCGTGGACACCGGTGTCGANCGCCACCAGCCGCATGTCTGCANGTCNATTCCGTCCTCGGCAACATCTTGAATGCCGA (SEQ ID NO. 611)

GCAGCGCCTGGGCGTGATCGGCAACCGGGGATGACCGCTCGCCGATCCGCTCGACAATCCCGGCGGCACGTGACATGC

GCCGCCACGGCTCGACGAGCTGGAACTTCAGCGACGACGATCCGGAATTGATCACCAGCACGGTGCTACTCATGGACC

CCTGCGCCTGAATCCCGTGATGGCCACGGTGTTGACTATTCGTCGACAGTGCACCCGAGATAGTCTTCACGGCTGCGT

::::::::::::Rv59T7.seq::::::::::::
CATGTATTGCCGTGCTCACGGCGCCACGCTCGATGGTTTCTCGAAGTCTCCGGGCTGGTGTACAGCTTCTCGTTGATC (SEQ ID NO. 612)

TCGTTCGCCACGCCGTCCTCTTCCCGCCGACGACCCGATCTCGATCTCCANAATGATCTTGGCGGCCGCCGCCGCCTT

GAGCAGCTCCTGGGCGATGGCCAGGTTCTCATCGATGGGCACTGCCGACCGTCCCACATGTGCGACGGAACAAAGATG

TCACCTTGCTCACGCGTGCGCNAGATCNCANAAGGGCCGGACATACTGTCNACTTGTCCTTGGGCAGTGGTCCGTGTC

AGCCCACGTGACGGGTACTTGGCGCGATAACGTGGTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv5
::::::::::::Rv5SP6.seq::::::::::::
GCCACCACGACCCGGCCGTAACTCTGCTCACGGAAATGCGGCCAGGCCGCGCGTAGCACGTGGTATCCGCCATAAAGG (SEQ ID NO. 613)

TGCACCTTAAGCACGGCGTCCCAATTCTCGAACGACATCTTGTGGAAGGTGCCGTCGCGCAAGATCCCGGCGTTGCTC

ACCACACCGTGCACGGCGCCGAATTCGTCAAGCGCGGTCTTGATGATGTTCGCTGCGCCGTCCTCGGTGGCGACGCTG

TCCTTAGTTGGCGACCGCCCGGCCCCCCTTGTCGCGAATCTCGGCGACGACCTCATCGGCCATCGCCGAACGGCGCCC

GTGCCCGTCGCGGGCGCCACCGAGGTCGTTGACCACGA

::::::::::::Rv5T7.seq::::::::::::
CAGGCATGCAACCTTTGTCCACACGGCGTCTACTCCGTGCAAGGTCCGACCGCTTCCACGTCCCGCCGTGACGGTGCT (SEQ ID NO. 614)

CCATCTCCCTCAGCAACGCGTGAAGTGGTCCGATCCCGCGGCTTCAGG

Clone Rv60
::::::::::::Rv60SP6.seq::::::::::::
GTTGAGACGCAACCAGCGCACAACGACGATTTGGCGTAGCGGCGGACGTCTGCTCGATTCGATCACGTCGCGCTCGCA (SEQ ID NO. 615)

TCGAGCATGGCCCGCGACGCTACACGATCGCCGTCGTCGATGACACGACCGAGCCGTACGCCGGCCGTAAGCCGCGCC

AGGATTCGGCGAAAAACGTCTACGTGGCGGGTGTACTGGGTGTCGAATGATTCGTGGGGTGCGTATGCGTCCTGCAAT

CGTCGACATAGATCCGTCGCCGCATCGCGTCGACAACTCCGGGTGAGTGGAATACACTTGCCGATCACGCGACGTGCG

CGGATCGATGCCGACCGAAATACGACCACATGGCTCTTGTTGCNCAGTGTTGGCGGCATCAAATACCCTCAGTGCCGT

CCGAC

::::::::::::Rv60T7.seq::::::::::::
TTNCCGCCTTNACGCCTACTCCNAGACGATGCTCGACGCGTGTGAGCACACGGCGCTGCTGTAGACGGCACGGCGCAG (SEQ ID NO. 616)

CTGGATCGCGCTTGGTGCACCCAAGCCTCTACGCGCGTCGCTGCGTCGTCATCGGGTACCGAACATATTCCGGTCGTT

GCGCAGAGTGTGCATGTGCGGCTCTTGTGAACGAACATAGCAAAGCGTATATGTCTGTGGCGGCTCTGCAGATATCGC

GATAATACGTATATACATAAGGTGGCGCGCGATCTATCGGTATATCCGTTATGGCGGACGTGCGTGAGCGTGAGTCGC

GGCGCATCGCGCACTTCGCGATCGCGTGACTGGTCCTCGCGACTGCGCGCATGCGTAGC

Clone Rv61
::::::::::::Rv61SP6.seq::::::::::::
GGTGATGACGCACTTGCTTCGAATGAGTCATTGACTACTCCCGTGGTTGTCCTGCGATGGTGGAGTGCCGCGCAGCCT (SEQ ID NO. 617)

TGCCCGANGTCGCGATCGCGTCGCGGGCTTCGGGGAGCAGACTGACCTGCAGATGGAAGTCGTGCCACATGCCCGCGA

ACGGCGAGCTCGATGCTTGTTTTCGAAGNGCGCANGCGGTTTCGATCTTGTCCGCGTCAACGCAGATCGGATCTCGCC

GCGGTCTGCATGACGATGGGCGCAGGCCCGCTCATGTCCCGTAGACGGGGAGATACGGGCAGCCGCGGATCGAGACCT

ACGTAGCGCGGCGCCCATCGTGCCATCGACGAAGAATGACGGATCGCGCAGCGCCGTCGCGTCGCTTCGATGTCACGC

GAGATCGCCACGGCAGATCAGCGATGCGCGGGC

::::::::::::Rv61T7.seq::::::::::::
CGGTACGCCGGCAACAAACGCCTTGTGACGAGCGCGTCCGAGCGGTCATCGGCCTCCACCGTCATGCACAGCTCCTTC (SEQ ID NO. 618)

TCCAGGTCTACGCCGACGTCGCGGTCCACATTGGTGAGCTTGGCGAATGCCTCGGCAACCTCGTCGAAATGCGCCTCC

GCGTCCGCATCGAAGGTCGCCATGTCAAAGATCAACTCGACGTAGTAGCTAGTTACCGCATCAGGTCAGTGTTTGCTG

GCCTCGGAGTCCGGCCGAACAATGGCCATTTCCCGCGACTCTAGAATCCAGTCATCGTCTCGGTGACGACGCCTTGCC

GATCACATAGCTCGACCGGATCGGAGAGAATCTGGTTCTCGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv62
:::::::::::::Rv62SP6.seq:::::::::::::
ATACTCAAGCTTAAGCGCAGCAGTACCGGCGGTGCCTGGGCATCCCAGCAAAACGGGGAGCTCAACGAACGATTCCTG (SEQ ID NO. 619)

AACGAAGGGTCGTCCACCAACCTCCAAACCGAACGGTTGCCAGCCCCGGC

:::::::::::::Rv62T7.seq:::::::::::::
GCAAGTCCGCTCAATGTGGTTGTGATCACANGACTACGTCGCCTCAATCAGCTCAAACGTCACCCCGTGGCGTGCTGC (SEQ ID NO. 620)

GCAGCATGAAGGTCGGCGCCCGCACGATGTGGGCGAAGCAACAGGTAATAACTGGTCGGCATGGGTCAACCCTCATTG

GGCCGTTGCGGATCGGGTGCACGCCCGGAGTGCCGGTCGAACTCAACACCGCCTTCACCGATCTTTTCGTCGAAAATG

GCGGTCGTGTCGGGGTATACGTCCGCGATCCCACGAGGCGGAATCCGCTGAGCCGCACTGA

Clone Rv63
:::::::::::::Rv63SP6.seq:::::::::::::
ATACTCAAGCTTCGCGCCCTCAAGCGGCTGAAGGTGGTTCCGGCGTNCCAACNGTCGGGCAACTCGCCGATGGGCATG (SEQ ID NO. 621)

GTGCTCGACNCCGTCCCGGTGATCCCGCCGGAGCTGCGCCCGATGGTGCAGCTCGACGGCGGCCGGTTCGCCNCGTCC

GACTTGAACGACCTGTACCGCAGGGTGATCAACCGCMACMMCMMGMTGAAAAGGCTGATCGATCTGGGTGCGCCGGAA

ATCATCGTCAACAACNAGAANCGGATGCTGCNGGAATCCGTGGACGCGCTGTTCGACAATGGCCGCCGCGGCCGGCCC

GTCACCGGGCCGGGCAACCGTCCGCTCAAGTCGCTTTCCGATCTGCTCA

:::::::::::::Rv63T7.seq:::::::::::::
TGCGCATGGCAGTTGTTGCCGGCTTGAGTCGCGTTAGCGCGGATTCCACCACATCCCTTGCGAAGTCGTGGGTGCAAT (SEQ ID NO. 622)

GATGTAGCGCTTCTCCCATCGAGATAGTGGAGCAACGCAATCCGTGCGTACGTTGGGTCGTACTCGAGTGCGCANCTT

GGCGTTGACACCATCTTTGTCATTGCGGCGAAGTCGATCATCCGGTAAGCGCGCTTATCGACGCCGCCTCTGTGCCGG

GTGGTAATCCGGCCATGCGCTTGCGTCCACCGCGACGTGCAGCGGGCGCACACCGACTTCTCCGGGTGACGGGTGATC

TCGGCGAATCAGAACCTGGCGCGCGACACAGCGTCGTGGCTGTACTTGC

Clone Rv64
:::::::::::::Rv64SP6.seq:::::::::::::
TGGGTGATCAGATACTGGCTAGTTGGTCGGGTGGGGTGATCGAAGATCGCGGTGGCCGGCAGCGTTACTGCGGTGACG (SEQ ID NO. 623)

CTGTTAAGCGGTTACGTACTCCACGGCACTCAANGAATTANATCCCGAATCGGCAAACCCTGGCCAGCGTCGAGTCCG

CAGCGCCGTCGCGCCCCCCACCGCTGCGGCATGCTCACATACCACCTCGATCGCTGCGGGAGTTGCTCGTCGGCCGAC

CGACCGGCCAGCCGGGCGGCAAACCGGAGGACCCAAGATTCAGCACCACCATCGCTAGCCCGATCTGGCCGCGCGTGG

:::::::::::::Rv64T7.seq:::::::::::::
TCGTAGCGGTTGCGACCANTCCGCGGACAGCTCCGCCACGCGACGGGTCGGGATCACCGCGGTCAAACCACCGAGCGG (SEQ ID NO. 624)

CGAGGATCTCTGGCCGTCGACGTGACCGCGCACGGCCGCGGTGATGGCCAGTCCCGACCGCCCTTCCACTTGGCGTAC

GCGCTGGATGTGTTGTGCCGCAACGGAATCCCACCTCAATTATGACCTCGTTGTGGGCGAGCGCGGTATCGTACGCCC

GACCAGGAATCGTCGATGCTATCTCACGTCACCGAAGGCCTCTCCCAGCACACCGCATCCAGAACGTGCACACNGTCG

ACATGTCTCGGCGGATCCGCCTGCAGAACGAACGCCANGTGCGCTGTGCGACACGGGTCGCGATCACCGCTCGCACGC

GGAGATCGGCACACGCGCAGCGCATCGATCATAATCTCTCGATGCGGTCTCCACCACCGAACAG

Clone Rv65
:::::::::::::Rv65SP6.seq:::::::::::::
ATACTCAAGCTTCGCTGAGGTGGTGGGGCACGATCACGTCACCGCACCGCTGTCGGTGGCGCTGGATGCCGGCCGGAT (SEQ ID NO. 625)

CAACCACGCGTACCTGTTCTCTGGGCCGCGTGGCTGCGGAAAGACGTCGTCAGCGCGTATCCTGGCNCGGTCGTTGAA

CTGTGCGCAGGGCCCTACCGCCAACCCGTGCGGGGTCTGCGAATCCTGCGTTTCGTTGGCGCCCAACGCCCCCGGCAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CATCGACGTGGTAGAGCTGGATGCCGCCAGCCACGGCGGCGTGGACGACACCCGCGAGCTGCGGGACCGCGCGTTCTA

TGCGCCGGTCCACTCACGGTACCGGGTATTTATCGTCGACGAGGCGCACATGGT

::::::::::::Rv65T7.seq::::::::::::
GCACTCACGCTGGTACAAGACCTTCACAAAATCTGAAATCCTGACCCGATACTTGAACCTGGTCTCGTTCGGCAATAA (SEQ ID NO. 626)

CTCGTTCGGCGTGCAGGACGCGGCGCAAACGTACTTCGGCATCAACGCGTCCGACCTGAATTGGCAGCAAGCGGCGCT

GCTGGCCGGCATGGTGCAATCGAGCAGCACGCTCAACCCGTACACCAACCCCGACGGCGCGCTGGCCCGGCGGAACGT

GGTCCTCGACACCATGATCGAGAACCTTCCCGGGGAGGCGGAGGCGTTGCGTGCCGCCAAGGCCGATCCGCTGGGGGT

ACTGCCGCAGCCCAATGAGTTGCCGCGCGGCTGCATCGCGGCCGGCGACCG

Clone Rv66
::::::::::::Rv66SP6.seq::::::::::::
ATACTCAAGCTTGTATAAAAAGATCGGTGAGCGCATCGATTCGCTCCGCCGGGTTTGCCGCTGCGGCGGCGGAGCTGC (SEQ ID NO. 627)

CGTGACCGTCTATTTGGGTGATCAGATACTGGGCTAGTTCGGTCGGGGTGGGGTGATCGAAGATCGCGGTGGCCGGCA

GCGTTACTGCGGTGACGGCTGTTAAGCGGTTACGTACCTCCACGGCACTCAAGGAATTAAATCCCGAATCGGCAAACG

CCTGGCCAGCGTCGAATCCGGCAGCGCCGTCGCGCCCCAGCACCGCTGCGGCATGCTCACATACCACCTCCATCGCTG

CGGCGAATTGCTCGTCGGCCGACCGACCGGCCAGCCGGGCGGCAAACCCGGAAGA

::::::::::::Rv66T7.seq::::::::::::
CCTCATCATATGCCGATAGAGCTCTACATATTCAGGAGATCACCATGGCTCGTGCGGTCGGGATCGACTCGGGACCAC (SEQ ID NO. 628)

CAACTCCGTCGTCTCGGTTCTGGAANGTGGCGACCNGGTCGTCGTCGCCAACTCCGGAGGGCTCCAGGACCACCCGTC

AATTGTCGCGTTCGCCCGCAACGGTGAGGTGCTGGTCNGCCAGCCCGCCAAGAACAGGCAGTGACCAACGTCGATCGC

ACCGTGCGCTCGGTCAAGCGACCATGGGCAGCGACTGGTCCATAGAGATTGACGCAAGAAATACACGCCCGGAGATCT

CGCCGCATTCTGATGAACTGAACGCGACCCGAGGCTACTCGGTGANGACATNACGACGCGTTATCACACCCCGCCTNC

TTCAATGACCCCACGTCNGGCACCAAGGACCCGGCAATCGCGGCTCACTTGNGCGATNGTCNACAACCAACGCGNCGC

CTGGCTACGGGCTCAACAAGGCANAAGACACAATCCGCTCTCGATTGGTG

Clone Rv67
::::::::::::Rv67SP6.seq::::::::::::
ATACTCAAGCTTATCGAGGCGGCGCATACCGAAGCGTGGGAAATCCAGACCGAATACCGCGACGTGCTGGACACTTTG (SEQ ID NO. 629)

GCCGGCGAGCTGCTGGAAAAGGAGACCCTGCACCGACCCGAGCTGGAAAGCATCTTCGCTGACGTCGAAAAGCGGCCG

CGGCTCACCATGTTCGACAACTTCGGTGGCCGGATCCCGTCGGACAAACCGCCCATCAAGACACCCGGCGAGCTCGCG

ATCGAACGCGGCGAACCTTGGCCCCAGCCGGTCCCCGAGCCGGCGTTCAAGGCGGCGATTGCGCATGCTACCCAAGCC

GCTGAGGCCGCCCGGTCCGACCCGGCCAAACCGGGCACGGCGCCAACGGTTCGCCCGCCGGCACCACCGGTCCGGTGA

CCGCAGTACGGTCCCCCAGCCTGACTACCGTGCCCCGGCGGGCT

::::::::::::Rv67T7.seq::::::::::::
TGGCCGGGCTGGTAGCCCGCGTATGGCAAGGTTCCGCTCAATGTGGTTGTGATGCAGCAGGACTACGTTCGCCTCAAT (SEQ ID NO. 630)

CAGCTCAAACGTCACCCCCGTGGCGTGCTGCGCAGCATGAAGGTCGGCGCCCGCACCATGTGGGCGAAGGCAACAGGT

AAGAACCTGGTCGGCATGGGTCGAGCCCTCATTGGGCCGTTGCGGATCGGGTTGCAGCGCGCCGGAGTGCCGGTCGAA

CTCAACACCGCCTTCACCGATCTTTTCGTCGAAAATGGCGTCGTGTCCGGGGTATACGTCCGCGATTCCCACGAGGCG

GAATCCGCTGAGCCGCAGCTGATCCGGGCTCGCCGCGGCGTGATCCTGGCCTGTGGTGGTTTCGAGCATAACGAGCAG

ATGCGAAT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv68
::::::::::::Rv68SP6.seq::::::::::::
GTCCAGTCAAGCATCGGTCCTCTCCGACTACGCCAAGANTGGCGACGTGTCAGTGCANACAGCGGANATGGTGGCGCC (SEQ ID NO. 631)

TATGCGTCGACGCTCACAAACNGCGGTGANCGCGTTCTGGTCGTGCACCATCGAGCCGTGCCAGCCCGGCCGCGTGCC

GTCAGCCGCATCCACTGGATGCCTTCTCGGNGTTTCAATCANGTACANGCGACGTTCGCCACCATCGTGCCGGGGCAC

GGTTAGCGAGAAACCGCCGACTTCACCGATTGCCTCGGTGATGCCGTCGAACAGATCGGGCCTATTGTCGACAGCCAG

TGTGATNCGTATTTGCCGCCGTGCTCCTCGTCGCAACGATGCGAACACAGATCCGTGGNGGACGATAGCGGCTGACAA

NGTGGGGGCAACACAATCACATGCCACATTTCTTCATTTCACGCCCACAACCCAGACTTCGTCTCGATGNGCCG

::::::::::::Rv68T7.seq::::::::::::
CACGCGGTCTGGCCCGATCCGAAGATCCCTTTGCCGGCGTGGCGGCTCTGCTCGGCGGTGTTGTACACTTCTCGAACA (SEQ ID NO. 632)

CCTCGGCACCGACACCACCACCGTNGCTTGAACACCGCCAACATCGGCAGCAGATCTTGATGGTCCTGGTGAATCCCA

CGGTGACTTTGGAGTGGAAGGCGCCATACTGATCGCCGCGCCAGCACATGAGCTAGCGGCAGGAAAACCAGCAGCCGC

TCACCTTGCGCAGCAGCGTCNGGTGATATGCCTGGCGCCCTTAATCTCGTGAACCAGTTGGATTGGGTCAACTGGCAG

CCTTGGGTCTCCGGTGGTGCCGANGTGTANATAAGCTCCCGGGTCCGTCAACGTANTGCGCAGGCGGCGGTTACTCGG

CGGGTCAACGAGCCCCGCTCGTGAGCNATCAGCCTTTGGACCGAACGGGATTCATACTCCGCAGGCGGCCCTCCGAAA

TCGGCACATGTCCTTTGATCGTTCGCAACAN

Clone Rv69
::::::::::::Rv69T7D3.seq::::::::::::
GGCCATGTCACATCGGTGGTACAGGTAAACCGCGCCGTGTGCGCGGTCTCGGAGATCAGAACGTGGTCGCAGTTGAAC (SEQ ID NO. 633)

CGCGGGCTTTCAGCCAGTCGCGATAATCGGCGGAAGTCGGCGCCTGCCGCCCCAACTAGCGCGACTCGCCACCTAGCA

CACCGATGGCGAAGGCCATGTNTCCGGCCACGCCGCCGCGGTGCATCACCAAGTCATCGACTAGGAAGCTAAGCGACA

NCTTGTGCAGGTGTTCGGGCAGTAGCTGCTCGGAAAATCGGCTGGAAACCGCATCAAATGGTCGGTCCAATCGAACCG

GTTACCCGATCGTCACAAAAATCTCCGTCCT

Clone Rv6
::::::::::::Rv6SP6.seq::::::::::::
GGGTCTACAACCACCGGGTCTGACTTCTGGGCTTCCACCGCTCGCGCCGTCGCGACAAACAGCGCGGTCGAACCGACA (SEQ ID NO. 634)

CTCGTTGTGATGTCCCAGCTATCACCTCCGGTAGGCACCCAATCGACCCTACCCGGCTATCTCACCCCCGATCTCCAG

GCTCCGCCGATCCATGCGCATCCCGGTCCGGATCCC

::::::::::::Rv6T7.seq::::::::::::
CAGGCATGCAAGCTTGTCGTATTCCGTGGCACTGTCAGACATATGCGCCGCTCCTCCTCATCGCTCCGCTCGGCATCG (SEQ ID NO. 635)

TCGCCGGCGGTCATGGCGTCACCCTACCCAAGCCGAACGCGAAACGAGAACGTGTTCCATTATTAGGGTGTGAGCACC

AATACCAGATTGCTCACCAGGAACTCACGCAGCACCGGGACGGATGTCAGCCACCACGCCCATCTGGGGTGGTAGCGG

GGAAATACGGCTAACGCGGCTCCGGTGCCGGCAGCCCAGCGCAGACCCTCGGCGGCGGACACGGCTAACAACGACGAC

CCATAGTTGTTCTTTGCCGGATGGCCGTGTTTGCTGACATATCGGGCGCGGCGCCGGCGCCGCC

Clone Rv70
::::::::::::Rv70SP6D2.seq::::::::::::
NCTACGCTGCTGAATGTTGTGCGCCGGAGGANCTCAAGACCCACGCGGTTGTACGCGGACNTGCGACATGTTCAACCG (SEQ ID NO. 636)

CCGGA

::::::::::::Rv70T7D3.seq::::::::::::
CTAACCAACAAGCCATGGTGGTTGGCGCCGTCGAGAGGTCGGCGGTCGCCACAACGGGAAGATCGCCTTGAGCGTCGC (SEQ ID NO. 637)

TCGACCGCCGCCTCGAGTTGGGTCATAACGAAGTACTGATGCCGATCATGTCGACGTGTCCGTCGCATCAGCGTGCAG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

CGGCGACCCCTCGACGAGCCTCGGTGCCGCCGCGGCCAGGGCACCAGCTGTTTAGCGCATTGTGCTCCGCCGGTAAT

AAAGGANGTCGGTCGCCTCCGCTGCTGTGGTTGCGGAATAACATCTTCCCTTCCTGCAACAGGATGAGAATGGTTTTA

ATTGCTC

Clone Rv71
::::::::::::Rv71SP6.seq::::::::::::
CTAAGCTTTCGGGTCCGCCGCCACTAGTACCGCGTTGCCGGCCCCGCCGACCTAGAATGTTCCGCCCATTGCCGTTTC (SEQ ID NO. 638)

CTCCCGCCGCCGGGTT

::::::::::::Rv71T7.seq::::::::::::
TCTGGTGCCGGGTGTGCCGACGGGTCCGTCCGCCTCTGCTTCAGTGATTCTGTGATGCGACCGGCAACGTCCTCCTTG (SEQ ID NO. 639)

TTCGGTGTCTATGTGGTCCGTCTCTCCTTGTTCCGCATACGATT

Clone Rv72
::::::::::::Rv72SP6D2.seq::::::::::::
GCGATCGNTNACCACAAGGGCGCAACCGTTCGCGCGTCGACTGAACGTGCTGCCGCCTGGAGAACTGGCGCTGCTGCC (SEQ ID NO. 640)

ACCTGGTCGGCGCATCGGCACTTCGAGGACTGGATTTCGACGCGTGGCCCGACCTGANGTNGGCGGTGGACNNGTGTG

CACCCGGTTGATTCCTCGGCCTTGCCGGGATGCCACCTGCGCCTGGTGGTCGAT

::::::::::::Rv72T7D3.seq::::::::::::
CGTGACCGGACGGGCTGCCGCGCGAACCGGTCTTGGCCAATTGCCGGGGACTGGGGCTGGAGTATAAAGCGGGCCTGT (SEQ ID NO. 641)

TGCCGGAAGATAAAGTCAAAGCGGTGACCGAGCTGAATCAACATGCGCCGCTGGCGATGGTCGGTGACGGTATTAACG

ACCGCCAGCGATGAAAGCTGCCGCCATCGGGATTGCAATGGGTAGCGGCACAGACTGGCGCTGGAAACCGCCGACGCA

CATTAACCATAACCACCTGCGCGGCTGGTGCAAATGATTGAACTGGCACGNCCACTCACGCCAATATCCGCCAGAACA

TCACTATTGCGCTGGG

Clone Rv73
::::::::::::Rv73SP6.seq::::::::::::
ATACTCAAGCTTCTTACCCANAGCATGAACCCCGCCGTCCAATGCCGCCACCGTGGTGCTGTCGGCCGGCCGGGTGCG (SEQ ID NO. 642)

GGCACAATCGCCGAGTTCGGCGAACAGATCCTCGAAGGTCTTCACGGCCAGCGATTGTTGCACGTGTCAGCCAGCCAA

GTCACGGTGGTTTGACGCCACACGTTCGCCACCGCCGCGCCGCGCATTAGGGCATCCTAATATAGGTTAGGCTACCCT

ANTTATTCCTGTGGTCNAAGGAGGCAGCCGAACGTGACCTTCCCGATGTGGTTCGCAGTTCCGCCGGAAGTGCCGTCA

GCATGGCTGTCCACCGGCATGGGCCCCGGTCCGCTGCTGGCCGCGGCCAGGGCGTGGCACGCGCTGGCCGCGCAATAC

ACCGAAATTGCAACGGAACTCGCAAGCGTGCTCGCTGCGGTGCAGGCAACTCGTGGCAGGGGCCCAGCGCCGACGGTT

CGTCNTCCCCATCAACCGTTCCGTATTGGCTAACCACCTGCACGGTGGCACCGCACAACGCCGCCACAAACGCGCCCC

GGTATAC

::::::::::::Rv73T7.seq::::::::::::
GGCCGAACTTAATCGGTTGTTGGCGGCTGCCGAGTTGGGTCACTCGGGGGGTGTGCACTGGCACATGGTGGGCCGGAT (SEQ ID NO. 643)

TCAACGCAACAAAGCCGGGTCGCTGGCTCGCTGGGCGCACACCGCTCACTCGGTGGACAGCTCGCGGTTGGTGACCGC

GCTGGATCGGGCGGTTGTTCCGGCGCTGGCCGAACACCGTCGTGGCGAGCGGCTGCGGGTTTACGTCCAGGTCAGCCT

CGACGGTGACGGATCCCGGGGCGGCGTCGACAGCACGACGCCCGGCGCCGTAGACCGGATTTGCGCGCAGGTGCAGGA

GTCAGAGGGCCTCGAACTGGTCGGGTTGATGGGCATTCCGCCGCTGGATTGGGACCCGACGAAGCCTTTGACCGGCTG

CAATCGGAGCACAACCGGGTGCGTGCGATGTTCCCGCACGCGATCGGTCTGTCGCGGGCATGTCCAACAACTTGAAAT

CCCGTCAACATGGTCGAC

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv74
::::::::::::Rv74SP6.seq::::::::::::
GCTTCCCCTGATACTCGACCAGCCCCACTCGGGCCAATACGTGAATGTCCTAGCATTTTTCACCCGTTCACGGGCTAG (SEQ ID NO. 644)

TCGAGTAGTAGACGATTGATTAGCCTGAACGTACCTCCGACGGCCAGCTGACGAACGGGTTTGACGGA

::::::::::::Rv74T7D3.seq::::::::::::
TCAGCTGTCTGTAGAAGGGCTGGCGATACTGTGCACTGTCTGATATCGCNNCGTNGTGGGACTATNCAGNCCATNANG (SEQ ID NO. 645)

ATGCGGTTCNGNNNNTGCAGAGNATCCTGGNACACATNCGGTTCACGTTAATCANCATCGCGANTTNCTNCGTNTTCG

ATTANTTCTGCTAACGNNTCTNNNAGTGCCTGCGGGTCGACTCTAGAG

Clone Rv75
::::::::::::Rv75SP6D2.seq3::::::::::::
NCTCTGCCGGGCNAGAGCGCAGAGTCGGACGGCTTCGTCGATCGTGAAGCGACCNTGCGATGANCAGATATCGNTNAC (SEQ ID NO. 646)

ACTGCTCANAAACTTCGGATCATCGNTGATACACAGGCCAACGGGTAGCGGTTGTCCAACCGCTTCGTCAACGANATG

GGATCGTGACGANCCTACGCTCGCAGGATATGTCGCNCACCNGNTCTAGANAN

::::::::::::Rv75T7D3.seq::::::::::::
CACTTCATGCTCGTGCGTTGGCNTCGATTTGCNCGAGNGGTTAGCTCCTCGAGTGNGTGACGTATCACTCCGGCNGAC (SEQ ID NO. 647)

TANCCGTATCNGCGTCCCGCACCGGTCAACTGGTCTAGCCACACCGGGGAGAATNCNCGACCGGNGCTATCGACCNAT

CACGGCTTGTCGNNAAGATAGNCAGCC

Clone Rv76
::::::::::::Rv76SP6.seq::::::::::::
ATACTCAAGCTTGCCAACCGCCACCCTGCATCCGGGGGGCGAGCACTGCTCCGCCGACCAGTACGAACCAACCTGCGG (SEQ ID NO. 648)

TGCCCAGGCCATTGACAATGTGCTGGTCGGCGCCCGCGAGTTCTAGCACAGCAACGCCGCGGCCACCACAGGGGCG

::::::::::::Rv76T7.seq::::::::::::
CGGTCGGTGTGCTTGGCGGCGTCGGTATCAACACCGCCCACGAAATGGGGCACAAGAAGGATTCGCTGGAGCGGTGGC (SEQ ID NO. 649)

TGTCCAAGATCACCCTCGCCCAGACCTGCTACGGGCACTTCTACATCGAGCACAACCGTGGCCATCACGTCCGGGTGT

CCACACCGGAAGACCCGGCGTCGGCGCGGTTCGGCAAAACTTTGTGGGATTTCCCGCCCCCCC

Clone Rv77
::::::::::::Rv77SP6.seq::::::::::::
AATACTCAAGCTTCGCGGAGGTGGTGGGGCAGGAGCACGTCACCGCGCCGCTGTCGGTGGCGCTGGATGCCGGCCGGA (SEQ ID NO. 650)

TCAACCACGCGTACCTGTTCTCTGGGCCGCGTGGCTGCGGAAAGACGTCGTCAGCGCGTATCCTCGCGCGGTCGTTGA

ACTGTGCGCAGGGCCCTACCGCCAACCCGTGCGGGGTCTGCGAATCCTGCGTTTCGTTGGCGCCCAACGCCCCCGGCA

GCATCGACGTGGTAGAGCTGGATGCCGCCAGCCACGGCGGCGTGGAGCAACCCCGCGAGCTGCGGGACCGCCC

::::::::::::Rv77T7.seq::::::::::::
GATGGCACTCACGCTGGACAAGACCTTCACAAAATCTGAAATCCTGACCCGATACTTGAACCTGGTCTCGTTCGGCAA (SEQ ID NO. 651)

TAACTCGTTCGGCGTGCAGGACGCGGCGCAAACGTACTTCGGCATCAACGCGTCCGACCTGAAATTGGCAGCAAACCG

GCGCTGCTGGGCCGGGCATGGTGCAATCCGAACAAGCACGCTCAACCCGTACACCAACCCCGAAGGGCCGCTGGCCCG

GCGGAACCTTGTCCTCCA

Clone Rv78
::::::::::::Rv78SP6.seq::::::::::::
AACAGCTATGACCATGATTACGCCAAGCTATTTAGGTGACACTATAGAATACTCAAGCTTCTGGGCGTCGTGGTGCCC (SEQ ID NO. 652)

GGCCTGCCGGTGCAGGAACTGGATTTTACTGCCATCTCTCGCGACCCTGAGGTGGTCCAGGCTTACAACACCGACCCA

CTCGTGCACCACGGACGGGTTCCGGCCGGGATTGGCCGCGCGCTGCTGCANGTGGGCGAGACCATGCCGCGGCGANCA

CCGGCATTGACCGCGCCGCTGCTAGTGCTGCACGGCACCGATGACCGGCTGATCCCCATCGAAGGCAGCCGTCGCCTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GTCNAATGTNTNGGATCNGCCGACGTGCANCTGAANGANTATCCCCGGCTGTNCCACNAGGTGTTCAACGAACCGGAN

CGCAACCAAGTG

::::::::::::Rv78T7.seq::::::::::::
CAAGGCATACGCCAAGACCCAAGGGATCGCAGTCACCTCCGTCAACGGCCTGGTCGCCGGCCACGGGTCCGTGCAGGA (SEQ ID NO. 653)

GACGTGGCTGGCCATGCAAAGCGCCGCCGCCTTATCAGGAACGCCCCGGCTTGTCGGCTTTTCCTGCATCGACACATT

TCCGGAGGTGTTGTGGTTGGCGCANCGCGCGAGACAGGCCTGGGATGGCGTGCGCATCGTCATCGGGAATGCGATGGC

AACACTGAACTACGAGCGCATCCTGCGCCAGCATGACTGTTTCGACTACGTCGTCGTTGGCGACGGGGANGTAGCGTT

CACCAAGCTGGCCTTGGCCCTGGCGAATGACCTGCGGTTGACGACTCCCGGGACTAACCCGCCGTANTGAGCAAGGAC

AGATTCTGCGCACACCCTCCTCGCTGGTCGACCTTGACA

Clone Rv79
::::::::::::Rv79SP6.seq::::::::::::
AACAGCTATGACCATGATTACGCCAAGCTATTTAGGTGACACTATAGAATACTCAAGCTTGCCGGTGATCTGGGTGGC (SEQ ID NO. 654)

CAACTCGGCGGGCACCATCTCCATCACGACNGCAAACGCTCCGGCTTCGGCGACAGCGATCGCGTCTGCGATNGTTTG

TTCGGCGGCGTCTCCGCGGCCCTGCACCCGGAAGCCGCCCAAGGTGTTGACNCTTTGCGGGGTGAAGCCGATGTGTGC

CATCACCGGGATNCCCGCCGCGGTCAGACANGCGATTTGCTCGGCCACCCGCTCACCGCCCTCGANCTTGACNGCATG

TGCGCCGCCGTCCTTGAAGAAACCGGTGGCGGNGGCAACCC

::::::::::::Rv79T7.seq::::::::::::
CGTTGAGATCCAGCTGCGCACTGTGCAGCGCCTCGGTGGTCTGCTCGGCCTGCCGGGATAACTCGTTGAGCTTCGCCA (SEQ ID NO. 655)

GCGCGTCGTCGGCCGGATCAGCCAGCACATTCGCGGCCAGGACGCCGGAGGAGACGGTGAAGCTCGCAAAGAAACCTA

TGGCGGACCGCATGATTACACGCGCGATCAACCACCTCTGGTCGAGCCTCAAAATTTGCTTCCTTAAACGGGCCATCG

ACGGATGACGTCGAGCTGGTTTAGGTCCAAACAGGTTACGAAACGATCTCGGAATTGTCCAAAAGGGGAAGTTTAAGA

AAATGGATAGATTTCTACCATTTCGCTGTGGACGATCGTACTTCTGCTATAGGGCTCCAGGGGCATCGACACGCAACG

ACCTTACGCGACACCGGATCCGCGCTGGCGGCGGAACGGCACCANGCGCAACCGAAGGGCCAATCCGACATCGG

Clone Rv7
::::::::::::Rv7SP6.seq::::::::::::
ATACTCAAGCTTATCTAGGCGCCAGCTTGATTGGTCTGGTTGCATTGGCCAGCTGCGCGAGCCTGGCTCACTTCAACT (SEQ ID NO. 656)

ACAACAACCGCAAACAATTGCCGCCTTCGGATCCGAGTTCGGTTGGGTACGCGGCAATGGANCACCATTTCTCGGTGA

ATCAGACTATTCCTGAGTACTTGATCATCCACTCTGCACACGACCTGCGAACCCCGCGCGGCCTTGCCGACCTGGAGC

AGCTGGCGCAACGTGTGAGCCANATCCCAGGCGTTGCCATGGTTCGCGGTGTGACCCGGCCAAACGGGGAAACCCTTG

AACAGGCCCGGGCGACATACCAAGCCGGCCAAGTTGGCAACCGGCTGGGCGGCGCGTCGCGAATGATCGATGAGCGCA

CCGGCGACCTGAATCGGCTGGCATCGGGTGCCAACCTGTTGGCCGACAATCTCGGTGACTTCGCGGTCAAGTCAGCCG

GGCCGTTGCGGGTGTCCGCAGCCTTGTCCAGCCCCTCGCTTACTCCA

::::::::::::Rv7T7.seq::::::::::::
CAGGCATGCAAGCTTTTTGAGCGTCGCGCGGGGCAGCTTCGCCGGCAATTCTACTAGCGAGAAGTCTGGCCCGATACG (SEQ ID NO. 657)

GATCTGACCGAAGTCGCTGCGGTGCAGCCCACCCTCATTGGCGATGGCGCCGACGATGGCGCCTGGACCGATCTTGTG

CCGCTTGCCGACGGCGACGCGGTAGGTGGTCAAGTCCGGTCTACGCTTGGGCCTTTGCGGACGGTCCCGACGCTGGTC

GCGGTTGCGCCGCGAAAGCGGCGGGTCGGGTGCCATCAGGAATGCCTCACCGCCGCGGCACTGCACGGCCAGTGCCCG

CGGCGATTCAGCCATCGGGACATCATGCTCGCTTCATACTCCTCGACCAGTCGGCGGAACAGCTCGATTCCCGGAACG

CCCACGCATGGTG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv80
::::::::::::Rv80SP6.seq::::::::::::
AACAGCTATGACCATGATTACGCCAAGCTATTTAGGTGACACTATAGAATACTCAAGCTTGTAGAAAAAGATCGGTGA (SEQ ID NO. 658)

GCGCATCGATTCGCTCCGCCGGGTTTGCCGCTGCGGCGGCGGAGCTGCCGTGACCGTCTATTTGGGTGATCAGATACT

GGGCTAGTTCGGTCGGGGTGGGGTGATCGAAGATCGCGGTGGCCGGCAGCGTTACTGCGGTGACAGCTGTTAAGCGGT

TACGTATCTCCACGGCACTCAAGGAATTAAATCCCGAATCGGCAAACGCCTGGCCAGCGTCNAGTCCGGCAGCGCCGT

CNCGCCCCAGCACCGCTGCGGCATGCTCACATACCACCTCGATCGCTGCGGCGANTTGCTCGTCNGCCGACCGACCGG

CCANCCGGGCGGCAAACCCNGAAGACCCAAGAATTCATCACCACCATCGCTAGC

::::::::::::Rv80T7.seq::::::::::::
CCTTCTTGACACCCACCTCGCCATCGACCTTGAGCACTCCGTCGTAGTTGGTGAACATGTGACCGGCGATCGGGCGGG (SEQ ID NO. 659)

TGAACGCGTACTGGGTGTCGGTGTCGACGTTCATCTTCACCACGCCGTAGCGCAGCGCCTCCTCGATCTCCGACTTAA

GCGAACCCGAGCCGCCGTGGAACACGAAATCNAACGGCTTGGCGTCNGCCGGCAGTCCGAGCTTGGCCGCCGCCACCT

GTTGCCCTTGCGCAAGGATGTCNGGGCGAANCTTGACGTTGCCGGGCTTGTANACGCCATGCACGTTGCCGAACGTCN

CGGCCAGCANGTATTTGCCGTGCTCACCGGCGCCCANCGCCTCGATGGTTTTCTCGAAGTCCTCCGGGCTGGTGTACA

GCTTCTCGTTGATCTCGTTCGCCACGCCGTCCTCTTCGCCGCCGACG

Clone Rv81
::::::::::::Rv81SP6.seq::::::::::::
AACAGCTATGACCATGATTACGCCAAGCTATTTAGGTGACACTATAGAATACTCAAGCTTGGAAAGGAGATCCCCGGG (SEQ ID NO. 660)

AACCTGGTGGCAACCCCGCCATTGGGGTTGTTGGGATTGCCGATCAGCGTGAANGAAGCTCTGTCTGGAGACAGCGGG

TCGGCCGAAGCCGCAAGATTGGCCATCACTAGTGACGANATCGTGGCGCTCTGCGAGTANCCNAAGACAGTGACGTTG

TTNCCGGCGGCAATTTGCTGCCGAATCGCACTTTCGAGAATGACNGCACCCTGCGCCACCGANGAATCNAAAGTGAGG

TTCTTGATCACGACCACCGGGTNGAGCCCTTGGGGCGTGAAGANCGCCTGCGCNATAACACCCGGGACGCTGCCACTC

ATGTNCAGCGCGTTCGCGANCTCNACATATCT

::::::::::::Rv81T7.seq::::::::::::
TCCTGGTGATCGANGGCCGCGGTTCCGGCCGAAAATCCGGTTCGGGTTCGGGTCGCGGTTCCAACTTGANCGCGGTCC (SEQ ID NO. 661)

GCAGCTGATTCACCGTGGCAACGCCGGCCAACTGCGCATAATGCGCATCCGAACCCTCACCCGCCCGCCCCGCGATCA

CCCCAACCTGATCCAACGACAACCGCCCCTCCCGCATACCCCGGGCGCAGCGCGGAAACTCCGGCAACCGCCGCGCCA

CCGTGGCGATCGTGTGGGCGTTGCCTGACGAACANCCCATCTTCCAGGCCACCAACCCCGCCACCGACCGCGCCCCCG

TCACACCCCACAACCCGTCGCGATCCAGCTCAGCCACGATCTCCACAATGCGCCCATCAATCGCATTGCGCTGAACGG

GCAACTCCGCCAACTCCTCCAA

Clone Rv82
::::::::::::Rv82SP6.seq::::::::::::
AACAGCTATGACCATGATTACGCCAAGCTATTTAGGTGACACTATAGAATACTCAAGATCTGGTACCCATCCGTGATA (SEQ ID NO. 662)

CATTGAGGCTGTTCCCTGGGGGTCGTTACCTTCCACGAGCAAAACACGTAGCCCCTTCAGAGCCAGATCCTGAGCAAG

ATGAACAGAAACTGAGGTTTTGTAAACGCCACCTTTATGGGCAGCAACCCCGATCACCGGTGGAAATACGTCTTCAGC

ACGTCGCAATCGCGTACCAAACACATCACGCATATGATTAATTTGTTCAATTGTATAACCAACACGTTGCTCAACCCG

TCCTCGAATTTCCATATCCGGGTGCGGTAGTCGCCCTGCTTTCTCGGCATCTCTGATAGCCTGAGAAGAAACCCCAAC

TAAATCCGCTGCTTCACCTATTCTCCAGCGCCGGGTTATTTTCCTCGCTTCCGGGCTGTCATCATTAAACTGTGCAA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv83
::::::::::::Rv83SP6.seq::::::::::::
AACAGCTATGACCATGATTACGCCAAGCTATTTAGGTGACACTATAGAATACTCAAGCTTANCGCCACCTCCCGGGCG (SEQ ID NO. 663)

GAACTCCACGGCGTGGATNAAGGTACCGGCCGGGATGTTGCGCAATGGCAGGTTGTTGCCCGGCTTGANGTCCGCGTT

AGCGCCGGATTCCACCACATCCCCTTGCGAAANTCCGTTGGGTNCNATGATGTNNCGCTTCTCCCCNTCNANATAATG

GANCAACGCNATCCGTGCGGTACGGTTCGGGTCNTACTCCATGTNCGCGACCTTGGCGTTGANACCATCTTTGTCATT

GCGGCGAAAGTCNATCATCCGGTNAGCNCGCNTATGANCGCCGCCTTTGTGCCGGGTGGTAATCCGGCCATGCGCNTT

GCGTCCACCGCGAACGTGCAACGGGGGCNCCAACGANTTCTCCNGGGTTGAACCGGTNATCT

::::::::::::Rv83T7.seq::::::::::::
TGTGTGTGGTGGTAACCCATCTGAGCAGTGTGCCAAACCGGGGCAGCCAGCTCCCAATTGACGTGAGCCCGCTCACTT (SEQ ID NO. 664)

GCTGGGTAAGCGTCG

Clone Rv84
::::::::::::Rv84SP6.seq::::::::::::
AACAGCTATGACCATGATTACGCCAAGCTATTTAGGTGACACTATANAATACTCAAGCTTGCGGGTNATNGCCTTGGT (SEQ ID NO. 665)

CAACGGCACCGTGATCGGATCNGGGTCTACCGCACACATNGACTGGAGCTTCGGCGAANTCATCGCCTATGCCTCGCG

GGGGGTGACGCTGANCCCNGGTGACNTGTTCNGCTCNGGCACGGTGCCCACCTGCACGCTCNTCNAACACCTCANGCC

ACCGGAATCATTCCCNGGCTGGCTGCACGANAGCGANNTTGTCNCCCTCCAAGTCTAAAGGCTGGGCGANANAAGCAN

AACGTCCCGACNAACGGCACTCCTTTTCCNTTTGCTCTTC

::::::::::::Rv84T7.seq::::::::::::
GAAATCATTGATGGTTTGAGTCACCAGGCCGATCAAGCCTTCGCCGAGCCAAATTCCAATCAAGAGGCCCAAGCCCGT (SEQ ID NO. 666)

ACCAATCAGCCCGGCAACGAGGGATTCCGTCATTATCAGCCAAAATAACTGCTCTCGGGTTACACCCAAACAGCGCAA

TATGGCGAAAAACGGTCGCCGTTGCACGACATTAAATGTCACGGTATTGTAGATTAAAAAGATACCCACCAACAANGC

AATCAAACTGAGAGCGGTTAAATTGACCGTAAAAGCGTCCGTCATCTGTTTGACNGTGTCCCGTTGGGTATCCGACGT

TTCCATACGCACACCGGCCGGCAGTCTTTGTTGGATGCGTNTTGCAATGGCCTCATCTTTGATGATCAAATCGATGTN

GCTCAGTCTTCCGGGCATATGGAACAACTCTTGGGCCGTGGAAATATCAGCAATGATA

Clone Rv85
::::::::::::Rv85SP6.seq::::::::::::
CTTTCGCCCAGGCCGGCGCGGATGTCCTCATCGCTTCACGAACATCATCCGAGCTTGACGCTGTCGCCGAACAGATCC (SEQ ID NO. 667)

GCGCTGCCGGCCGCCGCGCCCACACCGTTGCCGCCGATCTGGCCCATCCCGAGGTGACCGCGCAGCTGGCTGGTCAGG

CCGTCGGAGCTTTCGGGAAGCTCGACATCGTCGTCAACAACGTTGGCGGCACCATGCCCAACACGCTGCTAAGCACCT

CGACCAABGACCTCGCGGACGCCTTCGCCTTCAACGTGGGCACCGCCCACGCGCTGACCGTCGCGGCGGTGCCGTTGA

CGACCAANGACCTCGCGGACGCCTTCGCCTTCAACGTGGGCACCGCCCACGCGCTGACCGTCGCGGCGGTGCCGTTGA

TGCTGGAACACTCCGGCGGCGGCAGCGTGATCAACATCAGCTCCACCATGGGCCGGCTGGCGGCGCGGGGTTTC

::::::::::::Rv85T7.seq::::::::::::
TGTGGGCTCCGATCCGGCGCGCATGGCATCGACGGCGACGCCGATCGATGACGGCCAGGCTTACGAGCTTGAGGGTGT (SEQ ID NO. 668)

GAAGTTGTGGACCACCAACGGTGTGGTAGCGGACCTGCTAGTGGTTATGGCGCGGGTACCGCGCAGTGAAGGGCNCCG

AGGGGGAATCANCGCCTTTGTCGTCGAGGCTGATTCGCCCGGGATCACCGTGGAGCGGCGCAACAAGTTCATGGGACT

GCGTGGCATCGAAAACGGCGTGACCCGGCTTCNTCGCGTCAGGGTGCCCAAAGACAACTTGATCGCANGGAAGCGACG

GTCTGAAGATCGCGCTGACCACACTGACGCCGGACGGCTGTCCCTACCGGCGATCCAACCGAGT

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv86
::::::::::::Rv86SP6.seq::::::::::::
GAGCTGGCCGAGCTGGACCGGTTCACCGCGGAACTACCGTTCTCGCTCGACGACTTTCAGCAGCGGGCTTGCAGCGCG (SEQ ID NO. 669)

CTGGAACGCGGCCACGGTGTGCTGGTGTGCGCGCCGACCGGCGCTGGCAAGACAGTGGTCGGCGAGTTCGCCGTGCAC

CTGGCGCTGGCGGCCGGCAGTAAATGTTTCTACACCACGCCGCTGAAAGCCCTGAGCAACCAAAAGCACACCGATCTC

ACAGCACGCTACGGCCGTGACCAGATCTGGCTGCTGACCGGTGACCTGTCNGTCAACGGCAACCGCCGGTGGTGGTGA

TGACCACCGAAATGCTGCGCAACATCCTCTAC

::::::::::::Rv86T7.seq::::::::::::
GATCTCTGGATCGGCGGGGCTCTCCGGGCCGGCCTCGGCGACCTCAGCGGGCCGCGCCTTCCGGCCGAACCATTCCCT (SEQ ID NO. 670)

AGCCATAGATGACCGCACCTCGATGCACGGTTTGGCGGCAACGCGGCAAGGCGTCNGTCGGGCCCAGCCGCGGCAATG

CGGGTACCCGGGAGCGCGGGTCNGTANACCANCGCTGGACTGCGTCGCGCGGTGCGTCNACNTCAAAGTCCCCGGCCT

CCCATATCGCGTATGACGCGGGCGCGCCCGGCACCANGGGTGCCGATCCGGCCGTCTCGAACACCACCGGCCCGCCAG

CCGCCGCGGGTCCGGCAGCNAACCCGCCCGCGCCGATACCCGCTGCCCGCGTGCGTGATTGACCGCCGCGCGCACGCT

GGCCANGGATCAAAGCCCGTG

Clone Rv87
::::::::::::Rv87SP6.seq::::::::::::
GGACGCGTAGCCCGCCAGGCCGGTCAGGGTGCCCTTCCAGTCCACGCCGCTGTGGTCGGCGAACCGCTTATCTTCAAT (SEQ ID NO. 671)

CGAGACGATCGCCAGCTTCATCGTGTTGGCGATCTTGTCCGAGGGCACCTCGAACCGGCGCTGCGAGTNCAGCCACGC

GATCGTGTTGCCCTTCGCGTCGACCATCGTCGATACCGCAGGCACTTGCCCCTCGAGCAGCTGGGCCGAGCCGTTGGC

AACGACCTCAGANGCACGATTGGACATCAGCCCTAGCCCGCCTGCGAACGGGAACGTCAGCGCAGTGGCGACGACACT

GGCCAACAGACAGCACCCAGCCAGCTTCAGAACGGTGATCGCGGCCGGGAAGCGCTCGGGCATGCGTNCTACAGTAGC

GACCTCCTGTCACTCCACGTGCCGCTCGGTCCAATAGAATCTTTCCGCGGGCGGGTGAATCTCTGCNGGATCGGGGCN

GGCGC

::::::::::::Rv87T7.seq::::::::::::
GCTCGTTGCCGGCGGCGATCTCGTCGAGCTCGTCTTCCATCGCCGCGGTGAAGTCGTAGTCGACGAGCCGACCGAAAT (SEQ ID NO. 672)

GCTGCTCGAGCAGACCGGTTACCGCGAACGCCACCCATGACGGCACCAGTGCACTGCCCTTCTTGTGCACGTNGCCGC

GATCCTGGATGGTCTTGATGATCGACGANTAGGTCGACGGGCGGCCGATGCCCAGCTCCTCGAGCGCTTTGACCAGCG

ACGCCTCNGTGTNNCGGGCCGGCGGGTTGGTGGCATGGCCGTCTGGGGTCAACTCGACNATGTCCAACCGTTGACCCG

GGGTCAGATGGGGCAGTCGCCGCTCGGCATCGTCAGCCTCGCCGC

Clone Rv88
::::::::::::Rv88SP6.seq::::::::::::
GTCTTTCGATGGCTGCTTCTTCGGCGCTGACGCTGGCGATCTATCACCCCCAGCAGTTCGTCTACGCGGGAGCGATGT (SEQ ID NO. 673)

CGGGCCTGTTGGACCCCTCCCAGGCGATGGGTCCCACCCTGATCGGCCTGGCGATGGGTGACGCTGGCGGCTACAAGG

CCTCCGACATGTGGGGCCCGAAGGAGGACCCGGCGTGGCAGCGCAACGACCCGCTGTTGAACGTCNGGAANCTGATCG

CCAACNACACCCNCGTCTGGGTGTACTGCGGCAACNGCAAGCCGTCGGATCTGGGTGGCAACAACCTGCCGGCCAAGT

TCCTCGAGGGCTTCGTGCGGACCATCAACATCAAGTTCCAAGACGCCTACAACGCCNGTGGCGGCCACAACCGCGTGT

TCGACTTCCCGG

::::::::::::Rv88T7.seq::::::::::::
GCCAGGTCGAGGTCCCATGCGCGTGGGCCATTGATGCTGATCGCCAGGACGTCAAANATTTGGTCCGGCGTCAGCTGG (SEQ ID NO. 674)

GCGAAAAACGTGGGCCCCAGGACTTGCCCGGAGCTGCCCGGGTTCCCGTCGCGCAGCTCGGCGGCCCCGGTCAGAAAN

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

AAATTGCGCCAGGTCGCACACTCCGCGCCGTANGCCAGCTGCTCCAGGGTGTCGGCATAGAGCCCGCGGGCCGCAGCG

TGCTCGCTGTCGGCGAACACCGCATGGTCGAGAAGCGTTGCCGCCCAACGGAAATCACCTGCGTCNAANGCTTCGCGG

GCCAACTCCAGCACTCGGTCGATG

Clone Rv89
:::::::::::::Rv89SP6.seq:::::::::::::
NAAACGTTCCGGCTTNGGTGCCGGGCGCTTATTTGCGTCTCTGGGATCACNCTCAGTCGCCGGCGGCTGCCGTTGGGC (SEQ ID NO. 675)

TATNANTTGCACCGANCCGGAAAATCCGCACNANAACTGCNAGTAGCGGCCTGCAGAANTGCATCCTCGGCGAANCNG

ACTACCGGTGGACANCNACAAGCGCCGCCGAACAACGCACTGGCCCGAGGGATNGGCGTCTATCGGCCCGGCCCGTCG

AACTNGGAACAGACNGTGCGGTTCTACCGTGATCTGGTGGGAATGCTCNACCANACCTTCCCNANNGCTACGGAACNA

CGGCGCGATATTCNGCCNTCCCANCTCGAGCCTGACNCTNGATATCGTCGANNCTCACCATCNCGATCNGCTGTGCCG

GTNTTGCTCGGACTN

:::::::::::::Rv89T7.seq:::::::::::::
CGAACGACGAACNCCNCAAGCCATGGTGGTTGGCGCCGTCAAAAGGTCCGCGGTCGCCACTACTGGAAAATCGCCTTG (SEQ ID NO. 676)

AGCGTCNCTCGACCNCCGCCTCGAGTTGGGTCNTAACGAAATACCTGATGCCGATCANGTCNACGTCTCCGTCGCNNC

AACGTGCAGCGGCGACCCACTCTACNANCTCTCGGTNCCGCCNCGGCCAGNGCACCACCAGTGACNAATCCNTGCGCC

NTCGGGCCNAGCANTCCCGGTGCNACCGNGGTGGGTCCGGCGATGGTNGGGTGTNCTCNNTACNGGAACGCCAGCGCN

ATCANCATCGGCANACTCNCGTCGATGTGCCGCGGCGCAACCATCCCCCACAATGATCNGGTGCGTCTGATCAGGCN

Clone Rv8
:::::::::::::Rv8SP6D.seq:::::::::::::
TTAGGCGTGACGGCGACCGGGGCCACTCCGCACAATCTGTACCCGACCAAGATCTACACGATCGAATACGACGGCGTC (SEQ ID NO. 677)

GCCGACTTTCCGCGGTACCCGCTGAACTTTGTGTCGACCCTCAACGCCATTGCCGGC

:::::::::::::Rv8T7D4.seq:::::::::::::
CGTCACCCCGATGCGCCCAGATCGGGGCTTCGCAGATAAAGCACGAACTGGCGGGCAAAACGTCGATCTCGGAGCCGG (SEQ ID NO. 678)

AAGGGCAATCAGCCGACCGTCGACGAACGACACCGGCGAGACCACTTAGGCAGTGACGGCCT

Clone Rv90
:::::::::::::Rv90SP6.seq:::::::::::::
CTTTTCNCGATGTCTCATGATNCCNANGGAGAACNNTGCNANCNCNGCCGCTGACNTNGCNCACCGCTNTGGCNGNGG (SEQ ID NO. 679)

TGACATTGGTGGTGGTTGCGGGCTGCNACGCCCGACTCGANGCCGANCCATNTNTTGCGGCCGACCGCNTNTCGTCTC

NACCGCANNCCCNATCTCNGCCGCNCCCGGTGGANCTACNGCTNCTTCGCCATCTCTCGCCNATGGCTCCNGCGNNTC

GCNCAACGTNTGGTTTGGTNANCTGCCTACCTGGTCNT

:::::::::::::Rv90T7.seq:::::::::::::
GCTGCGCCAGTCGTTCGGTGCGGTCATGCCGTTGGACCNACCATCGGAGTTAGTTGCCGAACCGCGGACCACCGCAAG (SEQ ID NO. 680)

CACCCGGTCCTGCTCGCGCACCGCGTCGGCCAACCGCTTGAGCACCACCACGCCGCAGCCCTCGCCGCGCACGAATCC

ATCCGCGTTGGCGTCNAANCTGTNGCATCGGTCGGTCGGTGACAGCGCCGACCACTTGGACAGCGCGATGGCGGTGAA

CGGTNANTAGGTGACCTGCCNCCNCGCCCGCCAATGCCCACCTCCGCTTCACNCATGCGAATGGTCTGACACGCCNAG

TGAATTGCCACCAGCGACAACAAAAATCGGTATCTNCNGCGACGGCGGACACGCNATCCCNACTGATACTCGATCCGC

CCCACCGCTTGNANCTCCGGGTTCCNGTGCTCATGTACCNTCATGTCGGTCTGCGCNCGATATTGACCATCGTGTTTC

CCACGANNANAGANCCTCATCACGCCGGTTCGAGTGCCG

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone Rv91
::::::::::::Rv91SP6.seq::::::::::::
CTGTGTGCGGNCGGCGCGATATCGGCCTTTTTACTAACCGAACCCGATGTGGGCTCCGATCCGGCGCGCATGGCATCT (SEQ ID NO. 681)

ACNGCGACGCCGATCGATGACGGCCAGGCTTACGAGCTTGAGGGTGTGAANTTGTGGACCNCCAACGGTGTGGTAGCG

GACCTGCTANTGGTTATGGCGCGGGTACCGCGCAGTGAANGGCACCGAGGGGGAATCANCGCCTTTGTCGTCTANGCT

GATTCTCCCGGGATCACCNTGGAGCGCNCCNCNANTTCATGGGACTGCGTGGCATCCAANACGGCGTGACCGGCTTCA

TCCNTCNGGGTGCCCAAAGACAACTTGATCNGCNNGGAAGCGACGTCTGAANATCGCGCTGATCNCACTCAACGCCGG

ACGCTGTCCTACCGGCGATCGCACCGGANTTGCCAANCCGCGCTNANNATNCGCGNGAATGNCCGTCCACNANTGCAT

GG

::::::::::::Rv91T7.seq::::::::::::
TGGGGTGCCGGGCGCCGAGTTGCGTCCCTGGGATCACGCAGAGTCGCCGGCGGCTGCCGTTGGGCTATGAATTGCACC (SEQ ID NO. 682)

GAGCCGGAAAATCCGCANCAAAACTGCGAGTAGCGGCCTGCAGAAGTGCANCCTCGGCGAAACGGAGTACGGTGGACA

ACGAAAAGCGCCGCCGAACNACGCACTGGCCCGAGGGATTGGCGTCAATCGGCCCCGCCCGTCGAACTTGGAAGANAC

ANTGCGGTTCTACCGTGATCTGGTGGGAATGCTCCAACNNACCTTCNCGGAAAGCTACGGAAGCNACGGCGCGATNTT

CGGCCTTCCCAGCTCGACCTGACGCTGGAAATCG

Clone Rv92
::::::::::::Rv92SP6.seq::::::::::::
NGGCNGGGAAGTTAATGCCCTACTGGTTCNATGCTCNCACNTCNCCNGTGACNNCCTGCNCCGACCCGCCGAGGTCCT (SEQ ID NO. 683)

GNCCGTNACCACCGANCNGGCGATCCGGGACTCTNGTACGCATCCAACANNGANCAACGTGCACGGGCGGAGTNGTNC

CGCCACTTCGNCNATGACGGGGTCGATCCNTTCGACGTCCGTCGCCGCGTCGCTCGAGTGGCGGTCACNCTCCNNGTA

CTCGACCNCACNGACGAGAGGACTCGANCCCATCTACGTGTGGACGAAACANATCTTCTGTCCNACGACTACACCACC

ACCCAGGCCATCGCCGNCGCCCGCGANGCCCCTTCGACGCCNTACTGGTCCNGNGGNGGCGCTCTCCGGTTGTCTNNC

NCNTGNCGTGTTCCTTCACNCACTGCCCNACATCGANCCCGAGCNATNCNANGTCCGTCAATC

::::::::::::Rv92T7.seq::::::::::::
GGACACTGTTCGCGTGCCCCTCGTCAAAGCCGGAGTGGTCGTGCTGCGCCGGACCCGACCCGACCTTCAGCGGGGGTT (SEQ ID NO. 684)

CACAGCTCCGTGGGTGCCGTTACTTCCGATCGCCGCAGTGTGCGCGTGCCTGTGGCTGATGCTGAACCTCACCGCGTT

GACTTGGATCCGGTTCGGGATCTGGCTGGTGGCCGGAACCGCGATTTATGTCNGCTACGGGCCCCGGCACTCGGCGCA

TGGCCTTCGGCAAGCNCNANANAACGCGACCCGGAGGTGTTGAACTAGCTTCGCCGCGTATTTACAAATTGCNTTATA

TGTCTACACATAAGACGCAAACTGCTCTATTGTCAANTCCCANCGTGGTGTGGCNCATGAAGATGTTTGG

Clone Rv94
::::::::::::Rv94SP6.seq::::::::::::
TCCTTCTCGGTATCGGTTTGGGCTGTCACCANCAGTTGGTAGTTCTTCACGTNCTGTTGTTCGAGCGTCNAGCCGTCG (SEQ ID NO. 685)

CGCGTGTCNANGTCNCCGGACGCGTATCCCGCCAGGCCGGTCANGGTGCCCTTCCANTCCACGCCGCTGTGGTCGGCG

AACGCTNATCTTCAATCGAGACCATCGCCAGCTTCATCNTGTTGGCGATCTTGTCNNACGGCACCTCNAACCGGCGCT

NCTAGTACNCCACNCNATCNTGTTNCCTTCNCGTCNACATCCTCGATNCCNCNTGCACTTTCCCTCGANCNCCTGGGC

CGAGCCGTTGGCANTNACCTCNGAGCCCCATTGGACATCANCCCANCCCGCCTGCGAACGGGAACGTCAGCNCNCTGG

CGACAACCTGGCCAACAN

::::::::::::Rv94T7.seq::::::::::::
CACNCCGTGATCGCNAGCCCCNGTAGAAATNGTTGAGCCAGTTGGTGCGGCGCTCGTTGCCGGCGGTNATCTCGTCGA (SEQ ID NO. 686)

GCTCNTCTTCCATCGCCGCGGTGAAGTCGTACTCGACNAGCCGACCNAAATGCTGCTCNAGCAGACCGGTTACCNNNA

TABLE 3-continued

End-sequences of the polynucleotide inserts cloned in the named recombinant BAC vectors contained in the I-1945 *M. tuberculosis* H37Rv genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

ACNCCNCCTCNTGACNGCACCAGTGCNCTGCCCTTCTTGTGCACGTACCCGCNATCCTGGATGGTCTTGATGATCNAC

TANTNTGTCGACGGGCGGCCGATGCCCATCTCCTCNAGCGCTTTGACCAGCGACNCCTCGGTGTATCGGGCCGGCGGG

TTNGTGGCATGGCCGTCTGGGGTCANCTCNACNATNTTCANCCGTTGACCCGGGGTCACA

Clone Rv95
::::::::::::Rv95SP6.seq::::::::::::
TGGCCTTCTTGNCANGGGCNNACATNNGCTATNGCGAGCGTGTAACCGATCATCNTCCNGGCGACTGTGGCCTGANCG (SEQ ID NO. 687)

GCAAGGGTNGCCTNATTCNTCCTCCTGNGGCATGGTTNCCACACGGAATGNCGGTAAGTCTGGTCAACAACCTGGCCC

GCTGCGGGTTGGGTTCGGATTCGCTCGGCTANTAAGGTGCTCGCCTGGTGTNACNACTAATCNCNATATACNCTTANC

GGGAGTNGNCGTCCCGATCCTNGCCCTGCCGCNGGCGATCNCGTTCGCANCACCGCCACCGGAACTCNCAANGTGCGC

TCATCGGGCTCTACGCGCCATCTTCCCCGGATTCTTCGCGGCNGNGTNCCGNGGGACCCCGGACTGTGACNGGCCCAA

CGGCTCATCATCG

::::::::::::Rv95T7.seq::::::::::::
CCGGATAGCGGTGTCTGAACTTCGCCCGTTCCCTCCANCGCATTGAGCTTCAGCCCGACCGGCAGGTNNGGAGTCGGC (SEQ ID NO. 688)

ATGCGGTCCTTCGCCCCGACCCCGCTGGCTAAATANCCACCCCCGAGCGCGGTCACGGTCTTTGCACCGGGACGACGC

ATACCGGCAGCGCGAACATCNCCGCGGGCTGCAGCNTGAACGTCCAATACCANTCNAACAGTGTCCGCGCGTNAAAAC

CCGANCCGGCGGTCGCTTCNGTAATCAACGGCTCCTGCGCAACCAGCTGCAAGTCGCCGGTGCCACCGGCGTTGACGA

TCTTGATGTCTGCGANCTCGCGCACCAGCTCGACGGCCCGGGCA

Clone Rv96
::::::::::::Rv96SP6.seq::::::::::::
CCTCCCGACCACATACAGGCAAAGTAATGGCATTACCGCGAGCCATTACTCCTACGCGCGCAATTAACGAATCCACCA (SEQ ID NO. 689)

TCGGGGCAGCTGGTGTCGATAACGAAGTATCTTCAACCGGTTGAGTATTGAGCGTATGTTTTGGAATAACAGCCGCAC

GCTTCATTATCTAATCTCCCAGCGTGGTTTAATCAGACGATCGAAAATTTCATTGCAGACAGGTTCCCAAATAGAAAG

AGCATTTCTCCAGGCACCAGTTGAAGAGCGTTGATCAATGGCCTGTTCAAAAACAGTTCTCATCCGGATCTGACCTTT

ACCAACTTCATCCGTTTCACGTACAACATTTTTTAGAACCATGCTTCCCCAGGCATCCCGAATTTGCTCCTCCATCCA

CGGGGACTGAGAGCCATTACTATTGCTGTATTTGGTAAGCAAAATACGT

Clone Rv9
::::::::::::Rv9SP6.seq::::::::::::
CTTCACNTCCGTACGGCTCGGGTACGCTTCGGTCNCATTGTGCGAGTGATAGATGACGACCGGGACCTCGTCGGCATC (SEQ ID NO. 690)

TTCCATAGCCCGCCACACCTTCAGTTGCTCACCGGAATCCAACCGGTANAAGGTCGGCGANCGCTCNGCATTGGTCAT

CGGGATATGCCGCTCGGGACGGTCANAGCCCTCGGGTCCGGCCAGCACTCCGCAGGCTTCGTCGGGGTGGTCGCGACG

CGCATGGGCCACCATCGCATTCACCAGGTCTGCGCGAATCACCAGCACGTANACGGTTCCTTTCCTAAGCAACACCGA

ANTTTCAGGACCCGAATGCTCCGGGAAACATGTCACGGTAGGTCGGTATTCCGGCTACCGGCTGANCATTGAGCACGC

CGGCCAGCACCGCACGAACCAGGCAATCAGCCGCCGCCGCACCCGACCGCGG

::::::::::::Rv9T7.seq::::::::::::
CAGGCATGCAAGCTTGATGCCGCCGAAACCGAGCGTGAGCACGCCGCCAGCCACCACGCGCGGGTCGGGCGCCGGGCC (SEQ ID NO. 691)

CGGGCCGCCAGGCTGCTCCGCTCGGTGATGGCACGCCACCGCGACACCACCCGGCTGCGCTACCTCGAGCCATACCGG

GCGGAGCTACATCGGCTCGGCCGCCCAGTGTTCGGGCCCTCTTTCGN3GTCGAGGTCGATACCGATTGGCGCATCCGC

AGCCGCACCCTGGACGACAGAACCGTGCCCTACGAATTGCTTGTCGGGCGGGGCCAAAGAACAGCTTGGCATCCTGGC

GCGATTGGCCGGCGCGGCGCTGGTCGCCAAGGAAGACCCGTTCCGGTGCTGAT

TABLE 4

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone X0001
:::::::::::::::X0001SP6.seq:::::::::::::
AAG- (SEQ ID NO. 692)

TCGGGTTTCCACACGCGCGGTTTGACCCTAGTCATATGTAATCATGTGTACCATGTGCGGGCGCTTTTCGACGGCCG

CGAACCACCGGA-ATTTCCTGTGATTTCACTGCATGCGTACCATCTGGCACAATTGAGCA-TTGTCT-

TCGCGGTGGTCGG-CGGGTTGCGTGCCGCCTGCTGCGA-ATGCACCA-

TAAGCCCGAACCCACCGGCTTGGTGACCACCGCACGCTGCGTGTGGGGGGTAACCACTCCGCGACCCCAAGGATGGT

CATTTCCAATGAACCGGCTGGACTTCGTCCA-A

:::::::::::::X0001T7.seq:::::::::::::
GTCGCGGTTCGATCGACCCGATCTTCACCTCGTAACCTCGATGCTTAGCAGGATCCAGCTTGACCGCGTTTCGCTCT (SEQ ID NO. 693)

ACCCACTCTTTGAGTGGCGCCGTCGCCTGTGCCCCATCGGTGTTCATGACGAACGCTTCGAAAGACTTCCTCTTGTG

AGCCGGAATGTCTGCGTAAAGAAGTTCCATGTCCGGGAAGTAGACCCGGTCGCCCTCCACGTGGTACTCCTTCGAGG

TCCGCTTCTCGCCGGATCCGATAAACACCGGCCCCAGGCACCGCAGCGTGAGTTCGAACGGCTTCAGGTAGGTGTTC

ATGCGGCGGACTCCGGGAGTGCGAGAAATAGCGGTCGCGCGTAGCTGTAGACCGGATGGTTTCCGCCCAGGCTGACG

TCGAAGATGCCTCCTTGGAAGGGGCGCGA

Clone X0002
:::::::::::::X0002SP6.seq:::::::::::::
AACTCAAGTTTTTACGGTGATCGCGCATCACCTGGTTCATGAACTGGAAGCAGCGCAGCGCTTCCTTTTCGGCCGCA (SEQ ID NO. 694)

ACATGAGCCAGCCTCTCGTCGGCGGTCGGGTGCAGGTGCTCGGGCAGCTCGGCCGCGACAGCCGCCTGACCCTGAAA

CCAGCTTCCATATCCCGCGAC-

AACGACGCCAGTCCGCTACGTAACCCCTCCGCGACTGTCCATGGACAACAGCGCGTTCTCCACCGACCGGGCCCGGG

TGT

:::::::::::::X0002T7.seq:::::::::::::
GTGCAGGTTTCGACAATGTGGTGCCGGTTCGGCGGCTACGTGCCATCGAGACACTGGCGCA-GCTATCGCACCCGTT (SEQ ID NO. 695)

ATCGGCTGCGAGCAAATCGCGGTATGCGTTCTTGAGCATGAGTCGGCGACCGTCGTCATGGTCGACACCCACGACGG

AAAGACGCAGATCGCCGTCAAGCATGTGTGCCGCGGATTATCAGGACTGACCTCCTGGCTGACCGGCATGTTTGGTC

GCGATGCCTGGCGCCCGGCCGGCGTGGTCGTGGTCGGCTCGGATAGCGAGGTCAGCGAATTCTCGTGGCAGCTCGAA

AGGGTCCTGCCGGTGCCGGT

Clone X0003
:::::::::::::X0003SP6.seq:::::::::::::
TTCGAGTCATGCGCCCGCCTCGACCACGAA-ATGCACGTCG- (SEQ ID NO. 696)

GGTTCGATCGACCCGATCTTCACCTCGTAACCTCGATGCTTAGCAGGATCCAGCTTGACCGCGTTTGGCTCTACCCA

CTCTTTGAGTGGCGCCGTCGCCTGTGCCCCATCGGTGTTCATGACGAACGCTTCGAAAGACTTCCTCTTGTGAGCCG

GAATGTCTGCGTAAAGAAGTTCCATGTCCGGGAAGTAGACCCGGTCGCCCTCCACGTGGTACTCCTTCGACGTCCGC

TTCTC

:::::::::::::X0003T7.seq:::::::::::::
GTCATGTGTACCATTTGCGGGCGCTTTTCGACGGCCGCGAAACACCGGAGATTTCCTGTGATTTCACTGCATGCGTA (SEQ ID NO. 697)

CCGTCTGGCACAATTGAGCAGTTGTCTGTCGCGGTGGTCGGCCGGGTTGCGTGCCGCCTGCTGCGAGATGCACCAAT

AAGCCCGAACCCACCGGCTTGGTGACCACCGCACGCTGCGTGTGGGGGGTAACCACGCCGCGACCCCAAGGATGGTC

ATTTCCAATGAACCGGCTGGACTTC-TCAACAA

TABLE 4-continued

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone X0004
:::::::::::::X0004T7.seq:::::::::::::
AACAGCGCGGTTGAACTGATAGGTGCGGCCCGGCTCGAGCAGGCCGGGCCATTTGTTCGATGCGGTTACCGAAAGAT (SEQ ID NO. 698)

CTCTTCGGTGACCTGCCCGCCGCCGGCCAGCTCGGCCCAGTGCCCGGCGTTGGCCGCCGCGGCGACGATCTTGGCGT

CCACGGTGGTCGGGG

Clone X0006
:::::::::::::X0006T7.seq:::::::::::::
GCATCTGGGCTGGCGGTGGTTCGCCGCTCCGAAGCCGTCGAACACCATCGCCAGCGCGGCTTCCACATCAACGACCA (SEQ ID NO. 699)

TTTCGGCCAGCTTGCGGCGCATCAGCGGCTTGTCGATGAGCGCCCCACCGAATGCCCGCCGCTGCCCGGCGTA-

CACAGCGATTCGACCAGCGCGCGGCGCGCGTTGCCGAGGGCGAACGAAGCGGTGCCCAACCGCAATCTGTTGGTCAG

CTCCATCATGCGGGTGAGTCCCTTGCCG

Clone X0007
:::::::::::::X0007SP6.seq:::::::::::::
ATCGGTTTCCAGCAACAGCCGATCGACGGCTTCGCCCA- (SEQ ID NO. 700)

GGCCGCTCCCGGGCGACCCGACCATTGCTGTCGCCGCGTAACGCCATCACGGATGACGCGCAGTTCGTCGCTGTCTA

GCTCCACCATCGCCTGCACACCGGCGGCCAGGACCCATTGGCCGTCGCACTCGTA-

AGCAGGTAATCCTCGTCGACGGACTCGGTAACCACCGCCGCCAGCTCCGCTGCCAGGTCGGCGGGGTTGACACCGGC

GGGCATCGGGATGGACGACGACGCGGTGCTGACGGCGCCTGTC

:::::::::::::X0007T7.seq:::::::::::::
AGCGGTTTCCCA-

GCGGGATGTGCTGTGAGCGCCGCACCACCAGCGCCGACGCTAAGGATGGAACGCACGGCATCTTCTGACGCGTAACC (SEQ ID NO. 701)

GCGTTGTGATCGCGAGCTGAGGAGACGGTATGGGGGAGGGTTCTCGGAGGCCATCTGGGATGTTGATGTCTGTCGAT

CTTGAGCCGGTGCAACTCGTCGGCCCGGACGGTACGCCGACGGCCGAACGCCGCTACCACCGTGACCTTCCTGAGGA

AACGCTGCGTTGGCTCTACGAGATGATGGTGGTCACCCGCGAGCTGGATACCGAATTCGTCAATCTGCACG

Clone X0008
:::::::::::::X0008SP6.seq:::::::::::::
CAAGCTTCCACAGGTAGGGATCGAGGAACAGCGCGTTGAACTGATAGGTGCGGCCCGGCTCGAGCAGGCCGGCCATT (SEQ ID NO. 702)

TGTTCGATGCGGTTACCGAAAATCTCTTCGGTGACCTGCCCGCCGCCGGCCAGCTCGGCCCAGTGCCCGGCGTTGGC

CGCCGCGGCAACGATCTTGGCGTCCACGGTGGTCGGGGTCATGCCCGCGAGCAGGATCGGCGAGCGGCCGGTCAGCC

GGGTGAACTTCGTCGAAAGCTTGACCCTGCCGTCGGGGAGGCGAACCACGGTCGGTGCGTANCTCCACCAAGCCCGG

GCAACCTCGGGGGTGGCGCC

:::::::::::::X0008T7.seq:::::::::::::
TGGACCTCATGACAACGCGGCGGCGATTACCCCCGCTACCGCCAGCAGCATGACGGCGGTAGCGAACACCGCCGGAT (SEQ ID NO. 703)

GCAGCGCAGGTGCGTCGATGTGCTCACGGAATCGCCCCGGCACCGCGATCTCGAGGATCACCAGTGCCACCCCCTGC

AGCGCGACACCGACGATTCCGTACACCGCCACGCCGATCAGGCCCTGGGCCAGCTGGCGTATATGGCGGCGATGGTG

ACGATGGCCAGCGCCACATACATTGTGGCGGCCAGAACCACGGCGTTGGGGCGGCGGTCGATGAACACTAGGCGACG

CAGATCGCCCGGGGTCAACAGGTTGACCATCAGAAAGCCTGCGA

Clone X0009
:::::::::::::X0009SP6.seq:::::::::::::
TTTGGTGCGGCCGGCAATCAACTTC-GCTC CAGCGGTTTCCCAGGCGGGATGTGCTGTGAGCGCCGCACCACCAGCGCCGACGCTAAGGATGGAACGCACGGCATCT (SEQ ID NO. 704)

TCTGACGCGTAACCGCGTTGTGATCGCGAGCTGAGGAGACGGTATGGGGGAGGGTTCTCGGAGGCCATCTGGGATGT

TABLE 4-continued

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

TGATGTCTGTCGATCTTGAGCCGGTGCAACTCGTCGGCCCGGACGGTACGCCGACGGCCGAACGCCGCTACCACCCT

GACCTTCCTGAGGAAACGCTGCGTTGGCTCTACGATATGNDGGTGGTCACCCG

:::::::::::::X0009T7.seq:::::::::::::
CGCCCAGGGCCGCTCCCGGGCGACCCGACCATTGCTGTCGCCGCGTAACGCCATCACGGATGACGCGCAGTTCGTCG (SEQ ID NO. 705)

CTGTCTAGCTCCACCATCGCCTGCACACCGGCGGCCAGGACCCATTGGCCGTCGCACTCGTAGAGCAGGTAATCCTC

GTCGACGGACTCGGTAACCACCGCCGCCAGCTCCGCTGCCAGGTCGGCGGGGTTGACACCGGCGGGCATCGGGATGG

ACGACGACGCGGTGCTGACGGCGCCTGTCGCGACGCTGAGCTCGGACACAGCTAGTAAATGTAGCCTAACCTACTTA

ATGGGTCGCAGCCCCCCGGGGTCGTCGCATGTCCAACGTTGCTCGACTGGAAGAAAATGCTCGTCGGGGAGCAAATG

GCACC

Clone X0010
:::::::::::::X0010SP6.seq:::::::::::::
AATACTCAATCTTGATCGGTTTCCAGCAACAGCCGATCGACGGCTTCGCCCAGGGCCGCTCCCGGGCGACCCGACCA (SEQ ID NO. 706)

TTGCTGTCGCCGCGTAACGCCATCACGGATGACGCGCAGTTCGTCGCTGTCTAGCTCCACCATCGCCTGCACACCGG

CGGCCAGGACCCATTGGCCGTCGCACTCGTAGAGCAGGTAATCCTCGTCGACGGACTCGGTAACCACCGCCGCCAGC

TCCGCTGCCAGGTCGGCGGGGTTGACACCGGCGGGCATCGGGATGGACGACGACGCGGTGCTGACGGCGCCTGTCGC

GACTCTGAGCTCGG

:::::::::::::X0010T7.seq:::::::::::::
GGATGTGCTGTGAGCGCCGCACCACCAGCGCCGACGCTAAGGATGGAACGCACGGCATCTTCTGACGCGTAACCGCG (SEQ ID NO. 707)

TTGTGATCGCGAGCTGAGGAGACGGTATGGGGGAGGGTTCTCGGAGGCCATCTGGGATGTTGATGTCTGTCGATCTT

GAGCCGGTGCAACTCGTCGGCCCGGACGGTACGCCGACGGCCGAACGCCGCTACCACCGTGACCTTCCTGAGGAAAC

GCTGCGTTGGCTCTACGAGATGATGGTGGTCACCCGCGAGCTGGATACCGAATTCGTCAATCTGCAGCGCCAGGGGG

AAGCTGGCGTTGTACACGCCCTGTCGCGGGCAGGAAGCCGCGCAGGTGGGTGCGGCGGCTTGCCTACGCAAAACCGA

CTGGTTGTTCCCC

Clone X0012
:::::::::::::X0012SP6.seq:::::::::::::
ATCACGACAACAGCGACGGTGTGTCGGATCAGCGGCCCCCGTTGCCGGGCAATGTTGAGGCGTTTCTGCGTCTGGTT (SEQ ID NO. 708)

GAGGCCGGCTGGGAC-

CCGAGGTGGCTCGTCGGCCACATGGGCAGCACACCACCGTGGTGATGCATCTAGACGTGCAGGACCGTGCCGCTGGC

CTGCA

:::::::::::::X0012T7.seq:::::::::::::
GCGGCTACGTGCCATCGAGACACTGGCGCAGGCTATCGCACCCGTTATCGGCTGCGAGCAAATCGCGGTATGCGTTC (SEQ ID NO. 709)

TTGAGCATGAGTCGGCGACCGTCGTCATGGTCGACACCCACGACGGAAAGACGCAGATCGCCGTCAAGCATGTGTGC

CGCGGATTATCAGGACTGACCTCCTGGCTGACCGGCATGTTTGGTCGCGATGCCTG:

Clone X00013
::::::::::::X0013T7.seq:::::::::::::
TACAAGCGGCACCTCGCCGGTGAACTGACCGTTCGCACGCTGCGCACCGCCGCCGGGCGCGTGCTCGGCGCGCCCGC (SEQ ID NO. 710)

GGCCCCCGAGGCCTGAGAGGGGAACCAACCATGCAGGTGAACATGACGGTAAACGGCGAGCCCGTCACCGCCGAGGT

CGAACCCCGGATGCTGCTGGTCCATTTTCTCCGTGATCAGCTGCGGCTCACCGGAACTCACTGGGGCTGTGATACCA

GCAACTGCGGGACATGCGTGGTGGAGGTCGACGGCGTGCCGGTGAAATCCTGCACGATGCTCGCCGTGATGGCCTCC

GGGC

TABLE 4-continued

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

Clone X0014
:::::::::::::X0014T7.seq:::::::::::::
AGCGGCTGGTTACGACTCCCTGTTTGTGATGGACCACTTCTACCAACTGCCCATGTTGGGGACGCCCG-CC- (SEQ ID NO. 711)

TCCGATGCTGGAAGCCTACACTGCCCTTGGTGCGCTGGCC-C-GCGACCGAGCGGCTGCAACTGGGCGC-

TTGGTGACC-GCAATACCTACCGCACCCC-ACCCTGCTGG-CAAA-

ATCATCACCACGCTCGACTTGGTTAGCGCCGGTCGA-CGATCCTCGGCATTGGAACCGGTTGGTTT-

Clone X0015
:::::::::::::X0015SP6.seq:::::::::::::
ACGCGCGCCGATCATATCTGCTATGGATGTACAATTCAGCTCTTGCTGTTATACCAGTATATGGTGTACTATTTGAT (SEQ ID NO. 712)

CTATGCTGACGTGTGAGATGCGGGAATCGGCCCTGGCTCGACTCGGCCGGGCTCTGGCTGATCCGACGCGGTGCCGG

ATTCTGGTGGCGTTGCTGGATGGCGTTTGCTATCCCGGCCAGCTAGCTGCGCACCTCGGGTTGACUCGATCGAATGT

GTCCAACCATCTGTCGTGTTTGCGGGGCTGCGGGCTGGTA-TCCCAACCTATGAGGGCCGGCAGGTTCGGTAT

:::::::::::::X0015T7.seq:::::::::::::
CCGCGCTGCTGCTGACGTCGGTCGAACGTGCGACACGTCTGCGAATACCGGCCGAACGCTGGGTTTATCCACAGGCT (SEQ ID NO. 713)

GGCACCGACGCCCACGACACACCGGCCGTCGCCGACCGCCACCGACTGCATCGGTCGACGGCCATTCGGATCGCCGG

TGCCCGGGCGCTGGAACTGGCTGGGCTGGGGCTCGATGACATCGAATACGTCGACCTGTATTCGTGCTTTCCCTCCG

CTGTCCAAGTCGCCGCAATCGAACTCGGCCTGGACACCGACGATCCTGCCCGCCCGCTGACCGTCACCGGGGGCCTG

ACCTTCGCCGGCGGGCCGTGGAGCAATTACGTCACGCACTCCAT

Clone X0016
:::::::::::::X0016SP6.seq:::::::::::::
CAGGCGTGCAATGACCTGCACTGCGCCGGA-A- (SEQ ID NO. 714)

TCCCTAACCCACTAAACCGGGGCCGCTCACAAGCCGTGCAGCTCGGTCAGCGTCAGGTGCGCGACCAGGAA-

TAAATGAGCAGACCCGTGCCGTCAACGATGGTGGCGATCATCGGCCCCGAAACGATGGCCGGGTC-

ATGCGCAACTTCTTCAGCAGCGGCGGAAGGACGGCA-CCACCAGCGAC-ACCACACCACGAT

:::::::::::::X0016T7.seq:::::::::::::
GCGAA- (SEQ ID NO. 715)

CACTTCGTCAACTTCCAGGGCTGCCCGCACCAAGTATTTCGACGAGTATTTCCGTCGGGCCGCCGCCGCCGGCGCGC

GGCAGGTGGTCATCCTGGCGGCGGGGCTGGACTCGCGCGCGTACCGGCTGCCTTGGCCCGACGGGACCACGGTTTTT

GAGCTGGACCGCCCGCAGGTCCTTGATTTCAAGCGCGAGGTGCTCGCCAGCCACGGTGCCCAACCGCGCGCCCTGCG

CCGCGAGATCGCCGTCGACCTGCGTGACGATTGGCCACAAGCCTTGCGGGACAGTGGTTTCGATGCGGCTGCACCGT

CGGCATGGATTGCCGAAGGGCT

Clone X0017
:::::::::::::X0017SP6.seq:::::::::::::
TTGGGC-TTGCCC-CAATA-GGCCCCAATCAAAAGCCGAGCAGGTGGAACCTA-CGCATTCGCCTC-TCGT- (SEQ ID NO. 716)

TGTGCACCCGAGCCATCGCACGCGCGGGAATTCCCGGAT-TC-

CCGTATTCTCCGGCGGCCGGGCTAACCCATCCCA-GCCGAACGGTTGGCTC-

TGCCGTGGGTCCCGTGTTGGCCGATCGGGGCGTCACCGGGGGTGCTCGGGTGCGG-TGACCATGGC-AACTGCCCC-

ATGGGCCGACCCTGGTGCAGATAAACCTG

:::::::::::::X0017T7.seq:::::::::::::
TGGTGGAGGTCCCCACCAA-ACCCGGCCGTAACTCTGCTCACGGAAATGCGG- (SEQ ID NO. 717)

CAGGCCGCGCGTAGCACGTGGTATCCGCCATAAAGGTGCACCTTAAGCACGGCGTCCCAATTCTCGAACGACATCTT

TABLE 4-continued

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

GTGGAAGGTGCCGTCGCGCAAGATCCCGGCGTTGCTCACCACACCGTGCACGGCGCCGAATTCGTCAAGCGCGGTCT

TGATGATGTTCGCTGCGCCGTCCTCGGTGGCGACGCTGTCGGTA-

TTGGCGACCGCCCGGCCCCCCTTGTCGCGAAATCTCGGCGACGACCTCATCGGCCATCGCCGAACCGGGCGCCCG

Clone X0018
:::::::::::::X0018SP6.seq:::::::::::::
GCCGGCCAAACTGGCCGGCGGGGTTGCTGTC-TCAAGGTGGGTTCCGCCACCAA-ACC- (SEQ ID NO. 718)

CACTCAAGGATCGCAAGGAAAGC-

TCAAGGATGCGGTCGCGGCCGCCAAGGCCGCGGTCAAGGAGGGCATCGTCCCTGGTGGGGA-

CCTCCCTCATCCACCAGGCCCGCAAGGCGCTGACCGAACTGC-TGCGTC-C-GACCGGTGACAA-

GTCCTCGGTGTCCACGTGT-CTCCGAAGCCCTTGCCGCTCCGTTGTTCTGGATC-CC-CCAAC-

CTGGCTTGGACGGCTC-GTGGTGGTCAACAAGGTCAGCGAGCTACCCGCCGGGCATGGGCTGAACGTGA

Clone X0018
:::::::::::::X0018T7.seq:::::::::::::
CGAACCT-AATTGTCCTGTAATGCCCAGCTCACCAA- (SEQ ID NO. 719)

GCATGGCTGGTGGCCGGGGCGGTGAAGCCGGCGTCTGCGGCACCGTCCAACTC-ATGTGGAT-

GCCGGAATGGGGATGTCCGG-ACGGCGAATCCGTA-

TTCGCTTGTCCCGTGAGGCCCAGGTGGATGGGGGGAAGGATC-TGGTGTCCGGGATGAT-

ATGGGGCCGATGCCGCCGGTTGAAGTCCACTGGATCGGGAATTCGGGAATCGTGAT-CCGACGTTCAGGCCGAAC

Clone X0019
:::::::::::::X0019SP6.seq:::::::::::::
CTAACGGAATGAAAGCCCTGGTGGCCGT- (SEQ ID NO. 720)

TCGGCGGTGGCCGTCGTCGCACTGCTCGGTGTATCTTCCGCCCAAGCTGATCCCGAGGCGGATCCCCGCGCAGCTGA

GGCCAACTATGGTGGCCCCCCAAGTTCCCCACGTCTTGTCGATCACACCGAATGGGCGCA-

TGGGGAATTCTGCCCAGCCTCCGGGTCTACCCGTCCCAAGTTGGGCGTACA-

CCTCCCGCCGCCTCGGGATGGCCGCTGCCGACCCGGCCTGGGCC-

AGGTTCTCGCGCTGTCACCGGAAGCCGACACTGCCGGC

:::::::::::::X0019T7.seq:::::::::::::
CCGCGGGACAC-CCTC- (SEQ ID NO. 721)

ATGCTGCCGCCATGGACGCGGTCGAACGCAAGCAGCTGATCGAGCTACAACGCCGCGCGGAACGCTTCCGCCGCGGG

CGTGACCGCATCCCGTTGACCGGGCGGATCGCGGTGATCGTCGATGACGGCATCGCCACCGGAGCGACGGCCAAGGC

GGCGTGCCAGGTCGCCCGGGCGCACGGTGCGGACAAGGTGGTGCTGGCGGTCCCGATCGGCCCA-

ACGACATCGTGGCGAAGATTCGCCGGGTACGCCGATGATGTGGTGTGTTTGGCGACGCCGGCGTTGT

Clone X0020
:::::::::::::X0020T7.seq:::::::::::::
CTCTGGGACCGGCCACGGTGCC- (SEQ ID NO. 722)

CCGGCGTTCCCGGACGTGCTGCGCCAGGTGTCCGGCGGCCGCGTGCATGGTGTTCCCGGATCGCCCGCTGGCCAGAG

CCCACCGGTGAATCTGGCGCCTGGCCGACCACCGTGCGCCGTAGGCTTGCGATCGTGCAGCGCTGGCGTGGCCAGGA

CGAGATCCCGACGGATTGGGGCAGATGCGTGCTCACCATCGGGGTATTTGACGGCGTGCACCGCGGGCACGCCGAAC

TGATCGCGCACGCGGTCAAAGGCGGC

TABLE 4-continued

End-sequences of the polynucleotide inserts cloned in the named recombinant BAC vectors contained in the I-XXXX *M. bovis* strain Pasteur genomic DNA library.
RvXXXSP6 corresponds to the SP6 end-sequence of the clone RvXXX.
RvXXXT7 corresponds to the T7 end-sequence of the clone RvXXX.
RvXXXIS 1081 corresponds to a region located close to a copy of the IS1081 repetitive sequence (Insertion element).
The character << - >> denotes an uncertain base residue.

```
Clone X0021
::::::::::::::X0021SP6.seq::::::::::::::
AATACTCAAGCTTTCGTCAGTTCATTGCGCCAGCAGACCAACAA-AGCATCGGGACATACGGA-          (SEQ ID NO. 723)

TCAACTACCCGGCCAACGGTGATTTCTTGGCCGCCGCTGACGGCGCGAACGACGCCAGCGACCAC-

TTCAGCAAATGGCCA-CGCGTGCCGGGCCACGAGGTTGGTGCTCGGCGGCTACTCCCAGGGTGCGGCCGTGATC-

ACATC-TCACCGCCGCACCACTGCCCGGCCTCGGGTTCACGCAGCCGTTGCCGCCCGCAGCGGAC-

ATCACATCGCCGCGATCGCCCTGTTCGGGAATCCCTCGGCCGCGCTGGCGGGCTGATTAAC

::::::::::::::X0021T7.seq::::::::::::::
TGCCGCGGATTTGGCTGGCTGCCCAATATTCAGAATCGGGCCTTTCTTTTTGCGCGACAATAAGGTCACAGTAAACC (SEQ ID NO. 724)

CTCGTTTTGTGAGATGCGGGGCGGGCCGGGCGAA-

TCGACCTCGAGTGAATGGATCTCGAGTGAATGGACAGGGCATCGCCTACGAGTCGCATCCCCATCCAACAGACCGGT

GCTCTTGCATCGGACCCTGAAGGTCCCGCACGGAGGGTGTGGTTGCCGGCGCGGGCTCACGGTGCGGTAGCGACGTA

GTGTTTGAACGAATTTCTTGATGCTCCAACCTGTTTGGTGTTCAATCCAGTTCT

Clone X0175
.....X0175SP6.....
AA-CTTGCGCGCTCGGCCGGGTC-AGCATCCAGCTGCTCGGCAAGAGGCCAGCTAC-C-               (SEQ ID NO. 725)

TCGCTGCGTATGCCCAGCGGTGAGATCCGCCGGGTC-

ACGTCCGCTGCCGCGCGACCGTCGGCGAAGTGGGCAATGCCGAGCAGGCAAACATCAACTGGGGCAAGGCCGGTCGG

ATGCGGTGGAAGGGCAAGCGCCCGTCGGTCCGGGGCGTGGTGAT-AACCCGGTC-

ACCACCCGCACGGCGGTGGTGAGGGTAAAACCTCCGGCGGCCGTCACCCGGTTAGCCCGTGGGGCAA

.....X0175T7.....
A-TCGAAAGTGACCATCTCTACCTTGAGTGCCATACCGCCCGACCCTATGCCTCGGATAGCTCGGCGGAAAGAAACG (SEQ ID NO. 726)

CTTGCAGTGCCGCCGAATAGGCGGCTACGTCGTGAGCGCCCATCAACTCTCGCGCGGAGTGCATCGCCAGCTGGGCC

GCGCCGACGTCGACCGTGGGGATTCCGGTGCGCGCCGCGGCCAACGGCCCGATCGTCGACCCGCACGGCAGATCGGC

GCGATGTTCGTAACGCTGCATAGGCACTCCCGCGCGCTGGCAGGCCAGTGCGAACGCCGCCGCGGTGCGTCCG
```

REFERENCES

Altschul, S. F., W. Gish, W. Miller, E. W. Myers, and D. J. Lipman. 1990. Basic local alignment search tool. J. Mol. Biol. 215:403-10.

Balasubramanian, V., M. S. Pavelka, Jr., S. S. Bardarov, J. Martin, T. R. Weisbrod, R. A. McAdam, B. R. Bloom, and W. R. Jacobs, Jr. 1996. Allelic exchange in *Mycobacterium tuberculosis* with long linear recombination substrates. J. Bacteriol. 178:273-279.

Barany F., 1991, Proc. Natl. Acad. Sci. USA, 88:189-193.

Bensimon, A., A. Simon, A. Chiffaudel, V. Croquette, F. Heslot, and D. Bensimon. 1994. Alignment and sensitive detection of DNA by a moving interface. Science. 265: 2096-2098.

Bergh, S., and S. T. Cole. 1994. MycDB: an integrated mycobacterial database. Mol. Microbiol. 12:517-534.

Birnboim, H. C. and J. Doly. 1979. A rapid alkaline extraction procedure for screening recombinant plasmid DNA. Nucleic Acids Res. 7:1513-1523.

Burg J. L. et al., 1996, Mol. and Cell. Probes, 10:257-271.

Cai, L., J. F. Taylor, R. A. Wing, D. S. Gallagher, S. S. Woo, and S. K. Davis. 1995. Construction and characterization of a bovine bacterial artificial chromosome library. Genomics. 29:413-425.

Canard, B., and S. T. Cole. 1989. Genome organization of the anaerobic pathogen Clostridium perfringens. Proc. Natl. Acad. Sci. USA 86:6676-6680.

Chu B. C. F. et al., 1986, Nucleic Acids Res., 14:5591-5603.

Chuang S. et al., 1993. Global regulation of gene expression in *Escherichia coli*. J. Bact., 175(7): 2026-2036.

Chuang, S., D. L. Daniels, and F. R. Blattner. 1993. Global regulation of gene expression in *Escherichia coli*. J. Bacteriol. 175:2026-2036.

Cole, S. T., R. Brosch, K. Eiglmeier, T. Garnier, S. V. Gordon, C. Churcher, D. Harris, K. Badcock, D. Basham, D. Brown, T. Chillingworth, R. Connor, R. Davies, K. Devlin, T. Feltwell, S. Holroyd, S. Gentles, K. Jagels, J. McLean, S. Moule, L. Murphy, K. Oliver, J. Osborne, J. Parkhill, M. Quail, M-A. Rajandream, J. Rogers, S. Rutter, K. Seeger, J.

Skelton, R. Squares, S. Squares, J. Sulston, K. Taylor, S. Whitehead and B. G. Barrell. 1997. Genome Sequence of *Mycobacterium tuberculosis* H37Rv. Microbial Comparative Genomics, 2:174.

Collins, D. M., and D. M. Stephens. 1991. Identification of an insertion sequence, IS1081, in *Mycobacterium bovis*. FEMS Microbiol. Lett. 67:11-15.

Cousins D. et al., 1998, 36(1): 168-170.

De Wit D. et al., 1990, J. Clin. Microbiol., 28: 2437-2441.

Dear, S., and R. A. Staden. 1991. Sequence assembly and editing program for the efficient management of large projects. Nucleic Acids Res. 19:3907-3911.

Duck P. et al., 1990, Biotechniques, 9:142-147.

Guateli J. C. et al., 1990, Proc. Natl. Acad. Sci. USA, 87:1874-1878.

Kievitis T. et al., 1991, J. Virol. Methods, 35:273-286.

Kim, U. J., B. W. Birren, T. Slepak, V. Mancino, C. Boysen, H. L. Kang, M. J. Simon, and H. Shizuya. 1996. Construction and characterization of a human bacterial artificial chromosome library. Genomics. 34:213-218.

Kwoh D. Y. et al., 1989, Proc. Natl. Acad. Sci. USA, 86:1173-1177.

Landegren U. et al., 1988, Science, 241:1077-1080.

Liu, Y. G., and R. F. Whittier. 1995. Thermal asymmetric interlaced PCR: automatable amplification and sequencing of insert end fragments from P1 and YAC clones for chromosome walking. Genomics. 25:674-681.

Lizardi P. M. et al., 1988, Bio/technology, 6:1197-1202.

Matthews J. A et al., 1988, Anal. Biochem., 169:1-25.

Michalet, X., R. Ekong, F. Fougerousse, S. Rousseaux, C. Schurra, N. Hornigold, M. Vanslegtenhorst, J. Wolfe, S. Povey, J. S. Beckmann, and A. Bensimon. 1997. Dynamic molecular combing—stretching the whole human genome for high-resolution studies. Science. 277:1518-1523.

Misumi, D. J., D. L. Nagle, S. H. McGrail, B. J. Dussault, Jr., J. S. Smutko, H. Chen, O. Charlat, G. M. Duyk, C. Ebeling, L. Baldini, G. A. Carlson, and K. J. Moore. 1997. The physical and genetic map surrounding the Lyst gene on mouse chromosome. Genomics. 40:147-150.

Pavelka, M. S., Jr., and W. R. Jacobs, Jr. 1996. Biosynthesis of diaminopimelate, the precursor of lysine and a component of peptidoglycan, is an essential function of *Mycobacterium smegmatis*. J. Bacteriol. 178:6496-6507.

Philipp, W. J., S. Nair, G. Guglielmi, M. Lagranderie, B. Gicquel, and S. T. Cole. 1996a. Physical mapping of *Mycobacterium bovis* BCG pasteur reveals differences from the genome map of *Mycobacterium tuberculosis* H37Rv and from *M. bovis*. Microbiology. 142:3135-3145.

Philipp, W. J., S. Poulet, K. Eiglmeier, L. Pascopella, V. Balasubramanian, B. Heym, S. Bergh, B. R. Bloom, W. R. Jacobs, Jr., and S. T. Cole. 1996b. An integrated map of the genome of the tubercle bacillus, *Mycobacterium tuberculosis* H37Rv, and comparison with *Mycobacterium leprae*. Proc. Natl. Acad. Sci. USA. 93:3132-3137.

Poulet S. et al., 1995, Arch. Microbiol., 163: 87-95.

Ross B C, 1992, J. Clin. Microbiol., 30: 942-946.

Sambrook, J., E. F. Fritsch, and T. Maniatis. 1989. Molecular cloning: a laboratory manual, 2nd ed. Cold Spring Harbor Laboratory, NY: Cold Spring Harbor. N.Y.

Sanchez-Pescador R., 1988, J. Clin. Microbiol., 26(10):1934-1938.

Segev D., 1992, in <<Non-radioactive Labeling and Detection of Biomolecules>>. Kessler C. Springer Verlag, Berlin, N.Y., 197-205.

Sheng, Y., V. Mancino, and B. Birren. 1995. Transformation of *Escherichia coli* with large DNA molecules by electroporation. Nucleic Acids Res. 23:1990-1996.

Shinnick T. M. et al., 1987, J. Bact., 169(3): 108-1088.

Shizuya, H., B. Birren, U. J. Kim, V. Mancino, T. Slepak, Y. Tachiiri, and M. Simon. 1992. Cloning and stable maintenance of 300-kilobase-pair fragments of human DNA in *Escherichia coli* using an F-factor-based vector. Proc. Natl. Acad. Sci. USA. 89:8794-8797.

Spargo C. A. et al., 1996, Mol. and Cell. Probes, 10:247-256.

Stone B. B. et al., 1996, Mol. and Cell. Probes, 10:359-370.

Trieselman B. A. et al., 1992. Transcriptionally active regions in the genome of the archaebacterium *Haloferax volcanii*. J. Bact., 174: 30-34.

Trieselmann, B. A., and R. L. Charlebois. 1992. Transcriptionally active regions in the genome of the archaebacterium *Haloferax volcanii*. J. Bacteriol. 174:30-34.

Urdea M. S. et al., 1991, Nucleic Acids Symp. Ser., 24:197-200.

Urdea M. S., 1988, Nucleic Acids Research, 11: 4937-4957.

Van Soolingen D., 1993, J. Clin. Microbiol., 31: 1987-1995.

Willets, N., and R. Skurray. 1987. Structure and function of the F-factor and mechanism of conjugation. In *Escherichia coli* and *Salmonella Typhimurium*: Cellular and Molecular Biology (F. C. Neidhardt, Ed) Vol. 2 pp 1110-1133, Am. Soc. Microbiol., Washington, D.C.

Woo, S. S., J. Jiang, B. S. Gill, A. H. Paterson, and R. A. Wing. 1994. Construction and characterization of a bacterial artificial chromosome library of Sorghum bicolor. Nucleic Acids Res 22:4922-4931.

Zimmer, R., and A. M. V. Gibbins. 1997. Construction and characterization of a large-fragment chicken bacterial artificial chromosome library. Genomics. 42:217-226.

---

SEQUENCE LISTING (755 sequences)

SEQ ID NO: 1 - DNA, 12732 bp, Mycobacterium tuberculosis
acctgcgcttgcagagatcaaatagggcgcatgggtcagcatagtacaggtcgtcgcgcatctttgatgcatcggaataagatgtcaggcaattaaaagagaagccacggcgactcgcggcattcagcatgtcgagcgtcgcttcgatgtgagcgcaccattccgtgtccaacgatttcagacgaacattgaatattccactcgcgacgctatagtccgcctcccgatctatgcgcgccgcgcagatgaagtctgcgttcgcccgaccttcgaaacgtagtgcggccgcgcgcaccatttcgggggagacgtcgatgccggtgtaatcagttttgaagccacgcgcatctaggtagtccagtagagccccatagccacagcctagatcgttgatcgaaaatgggtccgccgcattgacaatgcgcaccagctggtcaaagcgcaacgcctgcccggcttcgccgttccaatcgacgccgcgcgggtgccgtgtgcttcgagtttcgatgcgtagtaacgggccacgtcagcgagcatggtcgttgcgtcttccgccatgaagctgcctcacgatttgtgtgtgtgggcgtcggtgcgtgggtccgagactataccttcaacagttgcatgccgaggctgcggcgggcaatgacccaaaaacccgccggcacggttcgccgagcaaggaagcgtggagacgatagataatttcactggcgacagtacctcaaatagtccggagcctcggctccgacgttaaagagcagatccagaatcgacacggcgggctcgaaccctccccacaattgcttataatcgcggtagccgtcataatcgaaccaagttacccggatgctaagttcgtcgaacacgcgctcatcgacatacgaacgggctgaggggccagagacatattcggtcgctgcggcctgttggcagaggttggccagtctctcggtcttgccgtcggctaattcgtagtcccacgaatttgccagtcgcgtgctgataccgagataactgcaaatcgcattcaatagacgcctgttgagtaaggaaagattcgtgtgctgttcttcgaggtaaatcggcgcgagccagtcagcgatctccgcaaaatgagcggccgcgctgtagttgaattctagtgcccgccagtgcgctttcgcccaatcggtgccgtcgatcagcgtctcacgtatcttttgatggaaacgtcccttcacctggacgggaacagttatccactgtaacccctggctcgttttgatccgatttctgtttcgccaatcacgcttggtatattgcatgtcatcatagatgatgaattcatcgacgaatgcaatcaggtcaaaatatcctcgccaaggtatgtaatttgattgaacaatcgcgactttcttcaacgcggtgtctccaatttagaataacaaatacgtcgcgcccgcgacagctccgctggagcgagttcaagcgattctgcgacatattcaatatggtgctcgggaaggccaggatgggccgcgacccggggcgtccggtgcgcgatgaacgtcgcatcgtctcctgtgagataattgcatccgatcatatagggctggctgcggctaggttgctggcaaaaagatatcgcggccgatccgtttctggttttgtcttgatgatcaaatccgcttccgttcacgagatcgattcctggtcttcccccagcgtcgcgatgtcgataggtgtcgcgctttgttcgtacccgcactacgcggcggcgagaacctcgccaccgaatcgggattggggggaggataccactcggtcgaggcccgtcaccggccttctagcgggttgaccatcagtgtttgcagggccctatcccggtatggcgcaccacgggatcggcagcgttccggttgctggcgtggtacctcgttgtggcgccgtggtccatgtcgattgagtgcgtggatcagtgtaaaccgttgcgcgccatgttctgtaggcactggttcgggttgtggttaggctgcacggttggcaggttaccaaccactgagcccctgggcggatgtgagctcggactccgcctatggggtgtaattttggcagattgggccgggtccccgtggtgaggactcctcaaccggattgggtaagcatgaggtggtgctggcagcggtgtcctggtcgctctcccgagtaggcccgttgtgactgtcatgtgggcgagcgggtttgcgcgcgtaggagacgatgattactacgcacgtgaccaaccacaagaacggtgcccatgtcaccgtggtgaaaacgagtggcgtggtaccgactacccctttggctcccagctgtccatagagcggcacgtagaacggctggcccgggaccgcgacgttgacgatgctcagcgccacggccaaactcacgcagacgccgaccgcgcggcggcggtctccatgggctgcgagttggtcgaatatcccagcaccaggaggcccgttggggtctcgggctaccagtgcagcgattggcaagacgaaaacgagatagtagaaggcgacgtccgcgggggagaaggtggcggtggcgagcaacacaatccccaccatgacaggcgggatacggcgtccgagcgccagcacggcgaccacgactatgactaggacagcaaacccgatctgcgttcgcggaccagtgaggaaaccctctgggatcttgcccgattgatagttcttgatgctatcggggatcagcaggagtgccttgccaaaggacacgttccgcgggtctcgaagccctccgaacgaactattgaacttgatgatgccgtggatcgactgtgcgatcgtccccgggaagcctcgtggccacaacagaaaggctgcgatattggacaccaccacgccggtgatcccgataccagcccaccgccattgtcgagccgccaacaacaccacgccgagaacgacgaactgcggctttaccaggacggccaagatcaccgtgatggtggcgaggccccaccgctgtcgggacaacgccacgaagtaagccagcgcgatcggtaccacgaaccctgtcgagttgcctcgatcgatgaccccccacgccgggatggccgcggcgcccagtgtcacgaagatgaccactcgctccagaccacgtgccccccgggccgcccagatggcgggagatatgaccgccatcgttagggcgaccaggtaacagatcagccccaagcgcggcgcacccagccaatggctgggtagtccgaaaatcgcatacggtatgcgggcgggggcccatgcagcaaccgcggtcggctggtaatcggcgggtagcgagatcaggtagtccgcgggattgggttgaatcccggcggcggcgaccatggcgtagtcgctgaagcagtgccgaccgatattcatgccccaatcaagccaacagtccccagggactaccaaaagagtggaaaagacgtcgaccgcgtaccactgactgagggcgtacgccgtcgccgccgaaatcaccgacgccagcaggatggtgccgagcatgagggtgcgctcggattgggagccgatcgcccagagccgctcccggctcgcggtcacggcaccgcgcaacacctccgggggtcgcttcatctggattctcctcggttctgcgcgaaacggtagcagagcgccatggttgccaacgcggtcgccgggcagtctagaccggatcttcctcgtggcaaccgacaacaggacgtcgttgccgaaagggcgctgggcaccgacatctaggatgaacccacagccacgccccgacgttatgccatggcgaagagcgaccggcaggagcgggaacccagtgaagcgagcgctcatcaccggaatcacaggaccggacggctcgtatctcgctaagctcccgctgaagggatatgtggccgctggtagcccggccgaggtctatttctgctgggcgacacggaattatcgcgaattgtatgggttgctcgcggtcaacagcatctggttcaatcacgaatcaccgcgtcacggcgagacattcatgactcgtaatcctgcaccatatcgcggtcggcaacgaggcgctgatcgatgcgcagacgctgatgcgccggcccacccggataggtatcagtattggggcgttccggccagcgtacgaggcgtgatcgaccgcgcaatgggtgtttgcgttgagtaataatctgaaccgtgtgaacgcatgcatggatggattccttgcccgtatccgctcacatgttgatgcgcacgcgccagaattgcgttcactgttcgatacgatggcggccgaggcccgatttgcacgcgactggctgtccgaggacctcgcgcggttgcctgtcggtgcagcattgctggaagtgggcgggggggtacttctgctcagctgtcaactggcggcggagggatttgacatcaccgccatcgagccgacgggtgaaggttttggcaagttcagacagcttggcgacatcgtgctggaattggctgcagcacgacccaccatcgcgccatgcaaggcggaagactttatttccgagaagcggttcgacttcgccttctcgctgaatgtgatggagcacatcgaccttccggatgaggcagtcaggcgggtatcggaagtgctgaaaccgggggccagttaccacttcctgtgcccgaattacgtattcccgtacgaaccgcatttcaatatcccaacattcttcaccaaagagctgacatgccgggtgatgcgacatcgcatcgagggcaatacgggcatggatgacccgaagggagtctggcgttcgctcaactggattacggttcccaaggtgaaacgctttgcggcgaaggatgcgacgctgaccttgcgcttccaccgtgcaatgttggtatggatgctggaacgcgcgctgacggataaggaattcgctggtcgccgggcacaatggatggtcgctgctattcgctcggcggtgaaattgcgtgtgcatcatctggcaggctatgttcccgctacgctgcagcccatcatggatgtgcggctaacgaagaggtaatgacatggcgcaagcgacatcgggcattcgcgcggcactttcgcaacctgctgtgtatgaggcgtatcagcggattgcgggcgctaaaagcgggcttgcgtggatcacaaccgaccccatccagtcgttgccaggcatgcgtactctcgacctcggttgctggccagcggtgatacacagctccccgccagtggacgtgacatgtacgagagacggcatgagcgcggaatgtgcgaccgtgccgtcgagatgaccgacgtcggcgctacggcagcccccaccggacctatcgcgcggggcagcgtcgctcgggtcggcgcggcgaccgcgttggccgttgcctgcgtctacacggtcatctatctggcggcccgcgacctacccccggcttgtttttcgatattcgcggtgttttggggggcgctcggcattgccaccggcgccacccacggcctcctgcaagaaacgacccgcgaggtccgctgggtgcgctccacccaaatagttgcgggccatcgtacccatccgctgcgggtggccgggatgattggcaccgtcgcggccgtcgtaattgcgggtagctcaccgctgtggagccgacagctattcgtcgaggggcgctggctgtccgtggggctactcagcgttggggtggccgggttctgcgcgcaggcgaccctgctgggcgcgctggccggcgtcgaccggtggacacagtacgggtcactgatggtgaccgacgcggtcatccggttggcggtcgccgcggcagcggttgtgatcggatggggtctggccgggtacttgtgggccgccaccgcgggagcggtggcgtggctgctcatgctgatggcctcgcccaccgcgcgcagcgcggccagcctgctgacgcccgggggaatcgccacgttcgtgcgcggtgccgctcattcgataaccgccgcgggtgccagcgcgattctggtaatgggtttcccagtgttgctcaaagtgacctccgaccagttaggggcaaagggcggagcggtcatcctggctgtgaccttgacgcgtgcgccgcttctggtcccactgagcgcgatgcaaggcaacctgatcgcgcatttcgtcgaccggcgcacccaacggcttcgggcgctgatcgcaccggcgctggtcgtcggcggcatcggtgcggtcgggatgttggccgcagggcttaccggtccctggttgctgcgtgttggattcggccccgactaccaaactggcggggcgttgctggcctggttgacggcagcggcggtagctatcgccatgctgacgctgaccggcgccgccgcggtcgcggccgcactgcaccgggcgtatttgctgggctgggtcagcgcgacggtggcgtcgacgctgttgctgctgctgccgatgccgctggagacgcgcaccgtgatcgcgctgttgttcggtccaacggtgggaatcgccatccatgtggccgcgttggcgcggcgacccgactgatttgtgccccaggtcgacaaatcacgccgtctcgtcagtgagcactccgtcctcgggtccgatccttccaggagacgttgcaacctgatttggctcaaattggtgcgcaccgagggtcgggcacatcgtagggtcgcaacagtcacatgtgtcactgcaccgggcgacacccgatgtcccggctctcagcgacagctgtctgacctgtggttttgttcccaagttggtcgtggctgtgcgggattggaggtggcgtgggggtcgcgtcgtatggattctcctcctcggttccgcgcgaaacggccgcaggcgcaatggtcaccaacttggccgcggtggagtctagcctcacattttcctggtcgcccccgacaaccaggaggtcgctgcagaacgggcgttccctacccacatctactatgaagcgacagcggcgccccgctgtgatggctgagcatgaccgacagaggcgggaagacagtgaagcgagcgctcatcaccggaatcaccggccaggacggctcgtatctcgccgaactgctgctggccaaggggtatgaggttcacgggctcatccggcgcgcttcgacgttcaacacctcgcggatcgatcacctctacgtcgacccgcaccaaccgggcgcgcggctgtttctgcactatggtgacctgatcgacggaacccggttggtgaccctgctgagcaccatcgaacccgacgaggtgtacaacctggcggcgcagtcacacgtgcgggtgagcttcgacgaacccgtgcacaccggtgacaccaccggcatgggatccatgcgactgctggaagccgttcggctctctcgggtgcactgccgcttctatcaggcgtcctcgtcggagatgttcggcgcctcgccgccaccgcagaacgagctgacgccgttctacccgcggtcaccgtatggcgccgccaaggtctattcgtactgggcgacccgcaattatcgcgaagcgtacggattgttcgccgttaacggcatcttgttcaatcacgaatcaccgcggcgcggtgagacgttcgtgacccgaaagatcaccagggccgtggcacgcatcaaggccggtatccagtccgaggtctatatgggcaatctggatgcggtccgcgactgggggtacgcgcccgaatacgtcgaaggcatgtggcggatgctgcagaccgacgagcccgacgacttcgttttggcgaccgggcgcggtttcaccgtgcgtgagttcgcgcgggccgcgttcgagcatgccggtttggactggcagcagtacgtgaaattcgaccaacgctatctgcggcccaccgaggtggattcgctgatcggcgacgcgaccaaggctgccgaattgctgggctggagggcttcggtgcacactgacgagttggctcggatcatggtcgacgcggacatggcggcgctggagtgcgaaggcaagccgtggatcgacaagccgatgatcgccggccggacatgaacgcgcacacctcggtcggcccgcttgaccgcgcggcccgggtctacatcgccgggcatcgcggcctggtcgggtccgcgctgctacgcacgtttgcgggcgcggggttcaccaacctgctggtgcggtcacgcgccgagcttgatctgacggatcgggccgcgacgttcgacttcgttctcgagtcgaggccgcaggtcgtcatcgacgcggcggcccgggtcggcggcatcctggccaacgacacctacccggccgatttcctgtcggaaaacctccagatccaggtcaacctgctggatgccgccgtggcggcgcgggtgccgcggctgctgttcctgggctcgtcgtgcatctacccgaaactcgccccgcagccgatcccggagagcgcgctgctcaccggtccgttggagccgaccaacgacgcgtacgcgatcgccaaaatcgccggcatccttgcggtccaggcggtgcgccgccaacatggcctgccgtggatctcggcgatgcccaccaacctgtacgggccaggcgacaacttttcgccgtccggctcgcatctgctgccggcactcatccgccgctatgacgaggccaaagccagtggcgcgcccaacgtgaccaactggggcaccggcacgccccgacgggagttgctgcacgtcgacgacctggcgagcgcatgcctgtatctgctggaacatttcgacgggccgacccatgtcaacgtgggaaccggcatcgaccacaccatcggcgagatcgccgagatggtcgcctcggcggtaggctatagcggcgaaacccgctgggatccaagcaaaccggacggaacaccacgcaaactgctggatgtttcggtgctacgggaggcgggatggcggccttcgatcgcgctgcgcgacggcatcgaggcgacggtggcgtggtatcgcgagcacgcgggaacggttcggcaatgaggctggcccgtcgcgctcggaacatcttgcgtcgcaacggcatcgaggtgtcgcgctactttgccgaactggactgggaacgcaatttcttgcgccaactgcaatcgcatcgggtcagtgccgtgctcgatgtcggggccaattcggggcagtacgccaggggtctgcgcggcgcgggcttcgcgggccgcatcgtctcgttcgagccgctgcccgggccctttgccgtcttgcagcgcagcgcctccacggacccgttgtgggaatgccggcgctgtgcgctgggcgatgtcgatggaaccatctcgatcaacgtcgccggcaacgagggcgccagcagttccgtcttgccgatgttgaaacgacatcaggacgcctttccaccagccaactacgtgggcgcccaacgggtgccgatacatcgactcgattccgtggctgcagacgttctgcggcccaacgatattgcgttcttgaagatcgacgttcaaggattcgagaagcaggtgatcgcgggtggcgattcaacggtgcacgaccgatgcgtcggcatgcagctcgagctgtctttccagccgttgtacgagggtggcatgctcatccgcgaggcgctcgatctcgtggattcgttgggctttacgctctcgggattgcaacccggtttcaccgacccccgcaacggtcgaatgctgcaggccgatggcatcttcttccggggcagcgattgacgcgccggcgcgtcaatctatttcgacattcgcgtgaagacgttttcccagaatcgactgttgtaggcgtagaactcccggccgcgtaggtaggcatgtgatattcgccttcccccgaacgggtagcggcgatgaaggtcgcccatgcggcgcagatcaccgaagaccgcgcttggttcccggtgcgagccgacgcccgtggtgtcgaactcgcacagcacacaccgaatcgtgaccggctcgcataccagcgcggcccgcaatatgaattcctggtcggcggcgatcccgaaatcaaggtcgtagccaccgatcttggccaccagcgatgatccgaagaacgatgcttgatgcggaacaacctgcttgccggccaggaatttgcgcaggctgaaaggtatcgggccgcgcacccgatcgagcccgacgagacgatccatcccgaagccccacaattcggacaccggtcccttgccggatagcgcctccacggcctgggctaccacgtcgggcccggaaaaacgatcggcggagtgcaagaaccacaacagatcacccgatgcgtgcgcgatgccctggttcatcgcgtcgtaccgcccgccgtcgggctcggactgccaatacgcgaagcctggttcacacccggacaggtatgccaccacgtcgtcgccgctgccaccgtcgattacgatgtgctcgatgcgtccccggtagcgttgcgcccgcacacttttcaccgtgcgctgcaacccgtcgaggtcgttgaacgagatcgttatcaccgagacggtcggagcagacgtcaccgagttcccctaggttgctggcggcgattgtggatcaccgggtcttgataccgatgaaggtgcctcgaagattcgccgcataggaacctccgagcaacgactcggcgatgcttggttccaagttgtcgtactcctccatcaccaggtcgacgccgacgtctttgatggcctgaagtaggtgctcgcgttgaatccagaatgaccggcgattgtcccaggacgcccattttgcggtgtcgcgctggccaaacgagcggtcgtcggaaaactcggtaaaccacctaccgggaagtccctcatgttcggtgggcgccgagagcatgaacttcaccggcgccggccgccgcagcaaccgatcggtcaattgtcgtgccgtcgtgggcaaccggagccatttatcgctccggttgatgatcgagaagtgcgtctggagaatcagcagcttgttcgttaccgacgagagggtttccaggtattgcttcggattctccaggtggtagaagaggccgcagcagaagacggtatcgaagagcccgtggttggcgatgttgagggcgttgtcgtggacgaaccggagattcggcaggttggtcttcgatttgatgtagttgcaggccgccatgttcagctcgcgaacctcgatcccgaggacctgaaatcccatgcgcgcgaacccgaccgcgtacccgccttccaagcagccgacatcggccaggcgtaggtggctcttgtccccgggaaagacggtttccagaatcccgcgcgccgagatgaaccaggacgattcgtctaacgtgcgcgaggactccggtatcgtcaaggttccgtcgtcgaggcgaacgttgtgggcggtgaattgtaccgcgccggccgaatgttcctgtgccatcacttggttagccccttcggctggtcctgggtttgtcgacatggtcaggctcgacagccgcgtcggagccgggagggccacacatccacgagccccctgcggctcggcgtcgcggcggcgagcttgcgccactgggtcttgagccgccgcgcgggtgtcgccccgcggtgctgcagcgccagcatggcgatccggggatggcgcgcgatggtttcctgcagcgcggcgcgcccctccgggcctggaacgttggcgatctggcgaaggatccagtcggccatgacggcgatgagctcctcgcgcgcggggtctcccgggaacaggtcgagcatcgcgtcaaacgtcgccgcatgccccggaccctgcgtcaaccagaactttggcgggtccaccacctggttgtgccacatgccttgggcgtggcggcgatacacggccatggtgtcgggcaacatggcgatgtcgccatgcaccgcgtgccggacgtgcagataccagtccaggggcatgacgtcggcaggaatgtcgtcgtagcgctcgaggcgacggtacacggccgagttggtctggatgaagttcatcaagatcaacgcatccaggctcaagttgccccgcacccgaaccggggggaacttcgagtccttggcatggccgtcctcccatatcactcggacgggatggaagcacaccgtcgtcttggggtgccggtcgaggaatgcgacctgtttgcttagcttcagcggatcgatccagtagtcgtccgcctcgcacaacgcgacgtactcgccgcgagcggccgacagggcgccggtcaggttcccattgaggccgaggttttcggtcctgaagatcggccggaacacgtgcgggtaccgctcggcgtactcacggatgatcgccggggtggcatcggtcgacgcgtcgtcggcgacgatgatctccaccgggaagtcggtttgctggtcgagaaagctgtcgaaggcctgacgggcgtagcccgcctggttgtgagtggtcgagacgatgctcaccttggggcaaagctggggactcaccgtcggcccttttcctgcgcggccgcaagggtattgcgatggcgaacgtgaatcgcctgtgcccgccggccgtcggccgtcgtggcctggtggtcggcggacgtacggcacacgctggcgaagtatagcgagggtgcactgacgttgggctcgaaccgcgtggcgcgcggtgtgggcgcaccgtctcgagtcggtgctggttggctcgc

SEQ ID NO: 2 - DNA, 289 bp, Mycobacterium tuberculosis
atactcaagcttgccgcaatcgaaaccaacctgtttgtgccgcaagaaattacgccgtggcccggcgccgatcaagaaacgccccggcgcgcggcggtgtcgtcgtatggcatgacgggcaccaatgtgcacgccattgtcgagcaggcaccggtgccagcccccgaatccggtgcaccaggcgacaccccggccacacccggtatcgacggcgcgctgctgttcgcgctgtcggccagctcgcaggacgcgctgcggcaaaccgccgcgcggctggccgattgggtct

SEQ ID NO: 3 - DNA, 278 bp, Mycobacterium tuberculosis
ttggcgggttggccacacacccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtccacgccgttcacctacgtgaccttgatgggatccgggggt

SEQ ID NO: 4 - DNA, 1280 bp, Mycobacterium bovis
ccgacccagacactgaccgggcgaccgctgatcggcaacggcacccccggggcggtcggcagcggggccaccggggcccccggtgggtggctgctcggcgacggcggggccggcgggtccggcgcggcgggctcgggcgcgcccggcggggcgggcggggctgccgggctgtggggtaccggcggggccggcgggatcggcggagccagcaccgtactcggcggcaccggcgggggaggcggggtcggtgggctgtggggcgccggtggggccggcggggccggtggaaccggccttgttggtggcgacggcggggccggtggggccggcgggaccggcggactgctggccgggctgatcggtgccggcggaggtcacggcgggaccggcgggctcagcactaatggcgacggcggggttggcggggccggcgggaatgccggaatgctcgccgggccgggcggcgccggcggagccggcggtgacggcgaaaacctggacaccggtggggacggcggggccggcggtagcgcagggctgctgttcggcagcggcggcgccggcggcgccggcggatttggtttcctcggtggggacggcggggccggtggcaacgccgggctgctgttgtccagcggcggggccggcgggttcggcgggttcggcaccgccggtggggtcggtggggccggcggcaatgccggctggctgggcttcggcggggccgggggcatcggcggaatcggcggtaacgctaacgggggcgccggtgggaacggcggcaccggcggtcagttatggggtagcggcggcgccggcgtcgaaggcggcgcagccttaagcgtcggcgacaccggcggggccggtggcgtcggcggcagcgccgggctgatcggcaccggcggcaacggcggcaacggcggcaccggcgccaacgccggcagccccggaaccggcggcgccggcgggttgctgctgggccaaaacgggctcaacgggttgccgtagccgggcggcacggcatggcttccgggcgtcaaccactcgccggtgatgcagatcggctgcggagcgggccgccaaaatgggggccgccgcgccaggtatctcggcgaagatccccggcgctcgagcgctttgtcagaggcccgtcgcgggtcgtcgtgacgacggctatccgggcggtgcgggtttcgcggcgcgccctgtgcccggcaccgccgcccgtttgtcggcaacgccgccgcgacccgtgagccgtccagcagctggcgcctgcg

SEQ ID NO: 5 - DNA, 127 bp, Mycobacterium bovis
gggcatcggcggaatcggcggtaacgctaacgggggcgccggtgggaacggcggcaccggcggtcagttatggggtagcggcggcgccggcgtcgaaggcggcgcagccttaagcgtcggcgacacc

SEQ ID NO: 6 - DNA, 434 bp, Mycobacterium tuberculosis
aatactcaagcttgcccagccgtcgatgacaagaaatatgtccgcaaaagactcagcggccgactttgctcgcagctggcggtaccgcgccaccgattctatgccgtggtcgcggaaaaatgcctcccgaaatcgcacggccgactccagttcggcgagcatccgcgatgccagctgcggctgcgccctgccggccacggcacccacatgcggcagttcgtccacctgggccagcgccccgccgccgaattccaaacaatagaactgcacccggcccgcatcgtgggtaacagccaacgccatgatcagcgtccgcagcgcggttgacttgcccgtttgcggtgcacctacgaacgcgacattgcctgcggccccggacaagtcgatcgtgcgcggcacccgtgactgctctaacgggcgattgaaattccgat

SEQ ID NO: 7 - DNA, 332 bp, Mycobacterium tuberculosis
ccacccgtgtaatttgggatgggcaaaaaggcgaagcaccgcgtggccacgaacgccgggagggacaatctcgggcggttagggcttctcgcgggaaggcccgaacgtacggcgtttcaacacctcgcgtcgccctccgaccgcgaacattcggggatggcagcaacctgctggcaccctggccgggcgatgatctgcagcgtcgccgcgggtagtcgccgcccgggcggctacactctgaaacgcgatgaccatcgatgtgtggatgcagcatcccgacgcaacggttcctacaccgcgatatgttcgcctcgctgccccggtggaccggt

SEQ ID NO: 8 - DNA, 354 bp, Mycobacterium tuberculosis
aatactcaagctttccgccgatacccgccatgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgagggcggagacaaaagtatcgctaaggtcaccgcgatcaccaacatggtgatcgcagcaatgttgctagtgatctatcgctccgtaattaccgcggttct

SEQ ID NO: 9 - DNA, 353 bp, Mycobacterium tuberculosis
gtgccgttccaacccgaattggctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccagacgacatcgtggcgagattcgccgggtacgccgatgaggtggt

SEQ ID NO: 10 - DNA, 279 bp, Mycobacterium tuberculosis
aatactcaagctttcggcggaaacggacacattgcgaatattgatgacaaaataaaaatcattgatggtttgagtcaccaggccgatcaagccttcgccgagccaaattccaatcaagaggcccaagcccgtaccaatcagcccggcaacgagggattccgtcattatcagccaaaataactgctctcgggttacacccaaacagcgcaatatggcgaaaaacggtcgccgttgcacgacattaaatgtcacggtattgtagattaaaaagatacccac

SEQ ID NO: 11 - DNA, 376 bp, Mycobacterium tuberculosis
  modified_base (99): a, t, c or g
tgctcccgaaacctgggggtgtgcctgctctgtatgcacggcatacggacatccttcccctgagacccgcggtcgaaccagccacgtgtccatcatagngggtcaaccccggccaagggcgacggcacgccaagttcgccgaccgttaacctagtgctgttagcttcatttgctgcgatcaaaacagctggtcggccgttaggaactgaattgaaactcaaccgatttggtgccgccgtaggtgtcctggctgcgggtgcgctggtgttgtccgcgtgtggtaacgacgacaatgtgaccgggggaggtgcaaccactggccaggcgtcggcaaaggtcgattgcggggggaagaagacactcaaagccagtgggt

SEQ ID NO: 12 - DNA, 393 bp, Mycobacterium tuberculosis
atactcaagctttgccgacgagcgggcgatgttgatgacgggaaaccccagcgcacaaccgacgattttggcgtagccggcggacgtctgctcgattccgatcacgtcggcgctcgcatcgagcatggcgccggcgacggctagcagcgatccgccgtcgtcgaggagcacgacacgagccgtacgcccggccgtaagccgcgcccaggattcggcgaaaaaccgttctacgtggcgggtgtactgggtgtcgaatgattcgtggggtgcgtaggcgtcgctgcaatcgtcgacatagatgccgtcgggccgcatcgcgtcgacaactccgggtgagtggaatagcacttgccgatcaccgcgacgttgcgcggatgaggccgaacccgaata

SEQ ID NO: 13 - DNA, 272 bp, Mycobacterium tuberculosis
  modified_base (21): a, t, c or g
tcctatgtccctgccgagcangtgatcgaacgcggtgacagatttgtctatcctggacctgacggtgaggtcgaagttttccaggaattcggcaaaatcggtaagagcctgaagaattcggtatcgccggacgaaatctgcgacgcatacgggggcatatacgcttcgggtttacgagatgtcgatggggccgctggaggcttcacgtccatgggccacaaaggatgttgtcggcgcgtaccgttttctgcagcgggtgtggcgcttggtcg

SEQ ID NO: 14 - DNA, 286 bp, Mycobacterium tuberculosis
atactcaagcttgattccgccgaaaccgaccgtgagcaccccgccagccaccacgctcgggtcgggcgccgggcccgggccgccaggctgctccgctcggtgatggcacgccaccgcgacaccacccggctgcgctacgtctaaccattccaggcggagctacatcagctcggccgcccagtgttcgggccctctttccaggtcgaagtctataccgatatgcgcatccgcagccgccaccctggagaacagaacgatgccctactaatgcttgtctggcggggcc

SEQ ID NO: 15 - DNA, 357 bp, Mycobacterium tuberculosis
ggtacgcttcggtcgcagtctgcgagtgatgcatgacgaccgggacctcgtcggcatcttccatagcccgccacaccttcagttgctcaccggaatccaaccggtagaaggtcggcgagcgctcggcattggtcatcgggatatgccgctcgggacggtcagagccctcgggtccggccagcactccgcaggcttcgtcggggtggtcgcgacgcgcatgggccaccatcgcattcaccaggtctgcgcgaatcaccagcacgtagacggttcctttcctaagcaacaccgaagtttcaggacccgaatgctccgggaaacatgtcacggtaggtcggtattccggctaccggctga

SEQ ID NO: 16 - DNA, 83 bp, Mycobacterium tuberculosis
ggcgtcaacggtgtcggaacccgcgtcaagcaattggtaggcctgcagtctgtgaatcaggccgacgctgtggccgccgcggc

SEQ ID NO: 17 - DNA, 383 bp, Mycobacterium tuberculosis
  modified_base (5): a, t, c or g
  modified_base (190): a, t, c or g
  modified_base (268): a, t, c or g
  modified_base (279): a, t, c or g
  modified_base (382): a, t, c or g
ggctngcgtacccggtaccggccgcgggcctaccacgtgccggaactggaagcgcagtaagccctcaacgcgccaccgctttggcccgcgcgcccggcgtaggcgcatcggcggtggccgtggggcggcgcactgcgacctcaccagcggctttcgagctttgttcgatcaaccggccagcatggtcgangatgcattcgagaccatattcgaaattggtttcatcgggggccccgatccgatgccccctcccagttgcgtgagcaancagcggagtcntcgcgggatcgatggccacggggtgttcaatggcggatggtccgctgcccgccgactggctcttgcgggagaaccgatctagcaccaccgatccgcgcacgtng

SEQ ID NO: 18 - DNA, 603 bp, Mycobacterium tuberculosis
  modified_base (7): a, t, c or g
  modified_base (17): a, t, c or g
  modified_base (21): a, t, c or g
  modified_base (38): a, t, c or g
  modified_base (51): a, t, c or g
  modified_base (82): a, t, c or g
  modified_base (100): a, t, c or g
  modified_base (103): a, t, c or g
  modified_base (112): a, t, c or g
  modified_base (115): a, t, c or g
  modified_base (121): a, t, c or g
  modified_base (176): a, t, c or g
  modified_base (231): a, t, c or g
  modified_base (241): a, t, c or g
  modified_base (243): a, t, c or g
  modified_base (250): a, t, c or g
  modified_base (284)..(285): a, t, c or g
  modified_base (293): a, t, c or g
  modified_base (297): a, t, c or g
  modified_base (348): a, t, c or g
  modified_base (379): a, t, c or g
  modified_base (422): a, t, c or g
  modified_base (441): a, t, c or g
  modified_base (489): a, t, c or g
  modified_base (507): a, t, c or g
  modified_base (527): a, t, c or g
  modified_base (531): a, t, c or g
  modified_base (544): a, t, c or g
  modified_base (555): a, t, c or g
  modified_base (578): a, t, c or g
cgtaatntcgcgcacanccangacttctggggggatcngctgacagtggtnggatcccaaattgcggatgatcgggccgccnacgtcgttgtgtacctcntcngtcacaacnaanccgaancgtatgactcggtccacgcggtgcggcacatggtggacaccacaccgccaccgcncggggtgaaggcctatgtcaccggtccggcaacactcaatgccgaccaggccgangccggacacnanagtatcnctaacgtcaccgcgatcacgagcatggtgatcgnncaatgttnctantgatctatcgctccgtaattaccgcggttctcgtcttgatcatggtcgcancgaactccggcgcaatccgcggattcatcgncttgctcgccgatcacatattttcagcctttcacattgcaacnaacctgctcgtctcatggngatgcggcgacacggactaccgatatcatgctcgccgttacacaatcncgccacgccgcgaagacnggaaacgcttctacacaatnttcncgggacgccactnaacttggttcnggtttgacattgccgcgcatgtntgcccagctttgccggctcccctta

SEQ ID NO: 19 - DNA, 190 bp, Mycobacterium tuberculosis
  modified_base (84): a, t, c or g
  modified_base (94): a, t, c or g
  modified_base (179): a, t, c or g
tgaatttcccgatcccacaatctcggttcagatacaggtcgccataccccttacttcggcaacgctgggcggattggccctgcngctgcagcanaccatcgacgccatcgaattgccggcaatctcgttcagccaatccatacccatcgacattccgccgatcgacatcccggccttcnccctttaacgg

SEQ ID NO: 20 - DNA, 506 bp, Mycobacterium tuberculosis
  modified_base (17): a, t, c or g
  modified_base (47): a, t, c or g
  modified_base (107): a, t, c or g
  modified_base (154): a, t, c or g
  modified_base (225): a, t, c or g
  modified_base (229): a, t, c or g
  modified_base (231): a, t, c or g
  modified_base (450): a, t, c or g
  modified_base (453): a, t, c or g
  modified_base (476): a, t, c or g
aacagctatgaccatgnttacgccaagctatttaggtaacactatanaatactcaagcttttacggtgatcgcgcatcacctggttcatgaactggaagcagcgcancgcttccttttcggccgcaacatgagccagcctctcgtccgcggtcnggtgcaggtgctcgggcagctcggccgcgacagccgcctgaccctgaaaccagcttccatatcccgcgacnaacnacnccagtccgctacgtaacccctccgcgactgtccatggacaacagcgcgttctccaccgaccgggcccgggtgtggggtgtttcggcgaccggcagccaggtggtccacactgccgacgggcgccgcgagccgttcaccgaccaagccgccgaacaagtccgcccgatcgcatactccaaccggttgcggtactgcaggtcagctggcgtacctcctcntcncgctcggcgaagtcttgctccancacgtcgcagaacggcaaggaacacgttca

SEQ ID NO: 21 - DNA, 388 bp, Mycobacterium tuberculosis
  modified_base (6)..(7): a, t, c or g
  modified_base (34): a, t, c or g
  modified_base (38): a, t, c or g
  modified_base (53): a, t, c or g
  modified_base (55): a, t, c or g
  modified_base (86): a, t, c or g
  modified_base (101): a, t, c or g
  modified_base (118): a, t, c or g
  modified_base (135): a, t, c or g
  modified_base (159): a, t, c or g
  modified_base (177): a, t, c or g
  modified_base (180): a, t, c or g
  modified_base (184): a, t, c or g
  modified_base (204): a, t, c or g
  modified_base (227)..(228): a, t, c or g
  modified_base (232): a, t, c or g
  modified_base (264): a, t, c or g
  modified_base (352): a, t, c or g
gaccgnnccatgtttccacaatgtggtgccagtncggnggctacgtgccatcnanacactggcgcaggctatcgcacccgttatcngctacgaacaaatcncggtatgcgttctttancatgagtcggcgaccgncgatcatggtcgacacccacgacngaaatacgcagatcgccntcnagcntgtgtgccgcggattatcangactgacctcctggctgaccggnntgtntggtcgcgatgcctggcgcccggccggcgtgntcgtggtcggctcggatagcgaagtcagctaattctcgtggcagctcgaaagggtcctgccggtgccggtctttgcgcaaaccatgcncatgttacggtccctcgggtgcggcctggcggcggc

SEQ ID NO: 22 - DNA, 138 bp, Mycobacterium tuberculosis
  modified_base (51): a, t, c or g
gggatgggcgggcccgctaaactcttcgtgttccactaactccgggagggncaatctcgggccgttatggctcacgtcgcgtcgccctccgaccgcgaacattcggagttggcagcaacctggtagcaccctggccgg

SEQ ID NO: 23 - DNA, 142 bp, Mycobacterium tuberculosis
  modified_base (1): a, t, c or g
  modified_base (131)..(132): a, t, c or g
nccgtcgttgacaagtaaatatgtccgcaaaagtctcagcggccgactttgctcgcaggtggcggtaccgcgccaccgagtcgatgccgtggtcgcggaagaatgcctcccgaaatcgcacggccttcccnntttaaacgga

SEQ ID NO: 24 - DNA, 441 bp, Mycobacterium tuberculosis
  modified_base (136): a, t, c or g
  modified_base (166): a, t, c or g
  modified_base (208): a, t, c or g
  modified_base (251): a, t, c or g
  modified_base (295): a, t, c or g
  modified_base (313): a, t, c or g
  modified_base (334): a, t, c or g
  modified_base (349): a, t, c or g
  modified_base (354): a, t, c or g
  modified_base (377): a, t, c or g
  modified_base (405): a, t, c or g
  modified_base (437): a, t, c or g
tttaggtgacactatagaatactcaagcttttggtctagccggccgagcacgatacgggtgtcattggccaccggcggcggctgtccgggaaatggcgggtccccggtggttttgctgatgagtgctgaaccgtantcgaagtgggcggcgtcagactccacccanccagcaggcagcgcgaagctgaatcctccaaccgggttgtcnatccggacaagttggggtgcgtttggggcaatgacaggtggcngcggtgcgttcgggtccgccggcggaagtgctgcgttgggatcncccgctgggcattcggcntttttgcggcggccggtggtnggggggcaacaggtntcccngtgcgggtggcgctcaacggtcnacggcgcaagccgccgttgttggtaccnggggcgctggctccggatcgcgttggcggtcnccgg

SEQ ID NO: 25 - DNA, 453 bp, Mycobacterium tuberculosis
  modified_base (29): a, t, c or g
  modified_base (199): a, t, c or g
  modified_base (280): a, t, c or g
  modified_base (302): a, t, c or g
  modified_base (325): a, t, c or g
  modified_base (331): a, t, c or g
  modified_base (368): a, t, c or g
  modified_base (374)..(375): a, t, c or g
  modified_base (395): a, t, c or g
  modified_base (401): a, t, c or g
  modified_base (423): a, t, c or g
  modified_base (426): a, t, c or g
  modified_base (432): a, t, c or g
  modified_base (444): a, t, c or g
ctacaccatcgaatacgacggcgtcgccnactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacgganaacctgccgctgctagagccactgcgatcggtgccgatcgtggggaacccactggcgaacctggttcaaccaaacttgaangtgattgttaacctgggctacngcgacccggcctatggttattcnacctcnccgcccaatgttgcgactccgttcgggttgttcccanaagtcnncccggtcgtcatcgccgaanctctcntcccgggacccacagggaatcngcnatttcncctacaaatcanccacctcca

SEQ ID NO: 26 - DNA, 228 bp, Mycobacterium tuberculosis
  modified_base (180): a, t, c or g
  modified_base (224): a, t, c or g
gcatgatcggccacctttcgggccgcccggcatacggcggcgtaccgatctccgcgtcatacacccgcgggtaatcgccgacggtgccggttcgcgagccgaaggtgacgactctgattgaatcgagttccaggtccagcgggtggcgcaccaacggcgcgagctcaacgacgtcaatcncgttgtcgctttctacggtcaccgaccctggtgaccgtagttcncccg

SEQ ID NO: 27 - DNA, 357 bp, Mycobacterium tuberculosis
  modified_base (53): a, t, c or g
  modified_base (161): a, t, c or g
  modified_base (226): a, t, c or g
  modified_base (242): a, t, c or g
  modified_base (306): a, t, c or g
  modified_base (335): a, t, c or g
gacactatagaatactcaagcttgccaaccgccagcctgcatccggcggcgancactgctccgccgaccagtacgaaccaacctgcggtgcccaggccattgacgatgtgctggtcggcgcccgcgagtccgcgcaccatcaacgccgcgggcaccaccanggcggccccaccctgcacggcgacgatcattccggcgccgctcacggcgggcggggctcgaacangcacagcatcaacgtngtcacccggccgtgaccggcccgcatcgtcacaccacccaagcccattgccgtcctcctcaacngggcgacccggcccgcatcgtcacacggnctaaggccattgccgtcctcct

SEQ ID NO: 28 - DNA, 384 bp, Mycobacterium tuberculosis
  modified_base (48): a, t, c or g
  modified_base (69): a, t, c or g
  modified_base (115): a, t, c or g
  modified_base (136): a, t, c or g
  modified_base (139): a, t, c or g
  modified_base (146): a, t, c or g
  modified_base (157): a, t, c or g
  modified_base (182): a, t, c or g
  modified_base (236): a, t, c or g
  modified_base (246): a, t, c or g
  modified_base (253): a, t, c or g
  modified_base (256): a, t, c or g
  modified_base (264)..(265): a, t, c or g
  modified_base (274): a, t, c or g
  modified_base (278): a, t, c or g
  modified_base (280): a, t, c or g
  modified_base (290): a, t, c or g
  modified_base (301): a, t, c or g
  modified_base (312): a, t, c or g
  modified_base (314): a, t, c or g
  modified_base (321): a, t, c or g
  modified_base (335): a, t, c or g
  modified_base (337): a, t, c or g
  modified_base (349): a, t, c or g
  modified_base (358): a, t, c or g
  modified_base (377): a, t, c or g
tcggcgccatcggcaccttcgaggacctgtatttcgacgccgtggccnacctgaggttggcggtggacnaagtgtgcacccggttgattcgctcggccttgccggatgccacccngcgcctggtggtcgatccgcnaanagacaanttgtggtggangcttctgctgcctgcgacacccacnacgtggtggcaccgggcagctttagctggcatgtcctgaccgcgctggccgacnactccagacnttccacnaanggtcgccnncccaatgtnccgnantgtctccggntccctttaccncccaatgggcngnttccacnggttacgggccccntnccggcgggtctncctcccaanctaccaaatacgcccgacnttccgga

SEQ ID NO: 29 - DNA, 266 bp, Mycobacterium tuberculosis
  modified_base (163): a, t, c or g
atactcaagcttttatggtgatcgcgcatcacctggttcatgaactggaagcagcgcagcgcttccttttcggccgcaacatgagccagcctctcgtcggcggtcgggtgcaggtgctcgggcagctcggccgcgaacagcccggcttgaaccctgaaaaccngctttccatatcccgcgacgaaagaacgccagttccgctacttaacccctccgcgaaccgtccatggacaacagcgcgttctccaccaaccgggcccgggtgt

SEQ ID NO: 30 - DNA, 423 bp, Mycobacterium tuberculosis
tcggctcaggccgcgctgctggtagagtcgctgaccggtgcaggtttcgacaatgtggtgccggttcggcggctacgtgccatcgagacactggcgcaggctatcgcacccgttatcggctacgaagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtcggctcggatagcgaggtcagcgaattctcgtggcagctcgaaagggtcctgccggtgccggtctttgcgcaaacaatagcgcaggttacggtcgcgcggggtgcggcctggcggcggcc

SEQ ID NO: 31 - DNA, 455 bp, Mycobacterium tuberculosis
  modified_base (94): a, t, c or g
  modified_base (195): a, t, c or g
  modified_base (216): a, t, c or g
  modified_base (282): a, t, c or g
  modified_base (446): a, t, c or g
caagctatttaggtgacactatagaatactcaagcttcgcgtctacgccggcccggagcatccgcacagcgctcagcagccggttccgtacganctcaagcaggtggcgcaatgaccgaaaccaccccagccccgcaaaccccggcggccccggccgggcccgcacaatcgttcgtgttggagcggcccatccanaccgttgggcgccgtaaggangccgtggtacgaatgcggctggtgcccggcaccggcaagttcgacctcaacggccgcagcttggangactacttcccaaacaaggtgcaccagcagttgatcaaggcacccctggtcaccgtggatcgggtggaaagtttcgacatctttgcccacctgggcggcggcggccgtccggtcaggccgggcctgccctgggtatcgcccgggcattgattctggtatccccngaagaaccg

SEQ ID NO: 32 - DNA, 371 bp, Mycobacterium tuberculosis
  modified_base (352): a, t, c or g
  modified_base (371): a, t, c or g
cggttggccaccgcttctgcggtgccgccgccgtcgacaatgaccgtgtcgtccttgctgaccaccacgcgtcgggccgagcccagcacctccaagcccacctcgcgcagcaccatgccggcgtcggggttgaccacctggccacccgtcaccaccgccaggtcctcaaggaaacgccttacggcggtcaccgaagtacggccccttgaccgcgaccgctttcaacgtcttgcgaatcgcgttgacgaccagcgtcgccaacgcttcgccctccacgtcttcagccacgatcagtagtggcttacccgttcctgcaaccttttccagcaatggcaacagatcgggaagcganctgatcttgtcttggtgcn

SEQ ID NO: 33 - DNA, 320 bp, Mycobacterium tuberculosis
  modified_base (62): a, t, c or g
  modified_base (85): a, t, c or g
  modified_base (160): a, t, c or g
  modified_base (165): a, t, c or g
  modified_base (204): a, t, c or g
  modified_base (217): a, t, c or g
  modified_base (260): a, t, c or g
  modified_base (279): a, t, c or g
  modified_base (282): a, t, c or g
  modified_base (292): a, t, c or g
  modified_base (300)..(301): a, t, c or g
ccaagctatttaggtgacactatagaatactcaagcttttggctgggtcgccttcgaattcngcgtgcaccgctatgggttgcancagcggctggcgccgcacaccccactggcccgggtgttttcgccccgaacccggatcatggtgagcgaaaagganattcncctgttcgatgctgggattcgccacgccaaggcatctancgattactctccncggggtgggaaaagtgcccaatccccctccctccaactttccnaacaatcattccggttccnccntccggttggnggtaaccnnccaataaaacccctgcccg

SEQ ID NO: 34 - DNA, 383 bp, Mycobacterium tuberculosis
  modified_base (7): a, t, c or g
  modified_base (74): a, t, c or g
  modified_base (189): a, t, c or g
  modified_base (196): a, t, c or g
  modified_base (198): a, t, c or g
  modified_base (224): a, t, c or g
  modified_base (238): a, t, c or g
  modified_base (323): a, t, c or g
  modified_base (326): a, t, c or g
  modified_base (332): a, t, c or g
  modified_base (350): a, t, c or g
gcccgcncatggccaatccccgaagacatcattggccagtggccgggcgctaacaggttccagccccccaccantgccgctcgaacatgcggtgcaacccattcgcaggccggcagggaaagcaccgcggaagccgcaaagggctgcagttccgcgcccaataatgtcgtccgcaaccagatgcgctcnaaaaccncnccggcagtcagcgcacccgacgcgangtcgaaagacgtcntcagcgcgcccacatggggtgccaatcggcacggcaggtatgccgcgcgcaacccgagcgcgtggtgcatgcccacggtccgcangangcgcancacccgccaatgccgaancccacgaaacatcgggcgcatccaccttcaacc

SEQ ID NO: 35 - DNA, 275 bp, Mycobacterium tuberculosis
atactcaagcttgcccagccgtcgatgacaagaaatatgtccgcaaaagactcagcggccgactttgctcgcagctggcggtaccgcgccaccgagtcgatgccgtggtcgcggaagaatgcctcccgaattcgcacggccaattccattccgggaagcatccgcaatgccagctgcggttgccccctgccggccacggcacccacttgcggcattgcgtccacctgggccagcgccccgccgccaaattccaaacaataaaaattgcacccggc

SEQ ID NO: 36 - DNA, 322 bp, Mycobacterium tuberculosis
ccacccgtgtattttgggatgggcaaaaaggcgaagcaccgcgtggccacgaacgccgggagggacaatctcgggcggctagggcttctcgcgggaaggcccgaacgtacggcgtttcaacacgtcgcgtcgccctccgaccgcgaacattcggggatggcagcaacctggtagcaccctggccgggcgatgatctgcagcgtcgccgcgggtagtcgccgcccgggcggctacagtctgaaacgcgatgaccatcgatgtgtggatgcagcatccgacgcaacggttcctacacggcgatatgttcgcctccctgccccgt

SEQ ID NO: 37 - DNA, 167 bp, Mycobacterium tuberculosis
  modified_base (126): a, t, c or g
  modified_base (134): a, t, c or g
  modified_base (137): a, t, c or g
  modified_base (141): a, t, c or g
  modified_base (147): a, t, c or g
  modified_base (164): a, t, c or g
ctgcccatgtttggggacgcccgaccagccgatgctggaggcctacacggcccttggtgcgctggccacggcgaccgagcggctgcaactgggcgcgttggtgaccggcaatacctaccgcagccngacccctntcncaanaggatnttgttcgccggaccccnctc

SEQ ID NO: 38 - DNA, 287 bp, Mycobacterium tuberculosis
ccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacgcgaccgccttt

SEQ ID NO: 39 - DNA, 322 bp, Mycobacterium tuberculosis
atactcaagctttgtcacaccaagtgtttcgaccaggcgctccatccggcgagtggatactcccagcaggtagcaggtcgccaccacgctggtcagtgcgcgttcagctcgcttgcggcgctgcagcagccattcggggaaatacctgccctggcgcagctgggggatcccaacttcaatggttgcggcacgggtgtcaaattcacggtggcggtagccgttgccctaattggaccgctcatcgctgctttcgcggtaccccgccccgcacagggcttcggcttcagcccccatcagggcggcaataaacttcaagagcacc

SEQ ID NO: 40 - DNA, 471 bp, Mycobacterium tuberculosis
gaggcagcttcgccggcaattctactagcgagaagtctggcccgatacggatctgaccgaagtcgctgcggtgcagcccaccctcattggcgatggcgccgacgatggcgcctggaccgatcttgtgccgcttgccgacggcgacgcggtaggtggtcaagtccggtctacgcttgggcctttgcggacggtcccgacgctggtcgcggttgcgccgcgaaagcggcgggtcgggtgccatcaggaatgcctcaccgccgcggcactgcacggccagtgccgcggcgatgtcagccatcgggacatcatgctcgcgttcatactcctcgaccagtcggcggaacagctcgattcccggaccgcccagcgcattggtgatggaatcggcgaacttggccacccgctgggtgttgacatcctcgacggtgggcaattgcgcctcggtaagctttgccgcgtagccttttcatc

SEQ ID NO: 41 - DNA, 247 bp, Mycobacterium tuberculosis
atactcaagcttcactgacaagggacgaattcgtcggccgcctgttcgactgggtggtggccgagctggtcgccaccactcaggccgcggtcacggcggtaccggcgcgggagcaaactcgcgcgggcatggccaacttcttgcggaccatcaccgcagacgcccgcttcggacccctgctgtccaccacacagttggccaacgcattaatcacccgcaagcttgcggaatccaccgccctgttcgc

SEQ ID NO: 42 - DNA, 325 bp, Mycobacterium tuberculosis
  modified_base (19): a, t, c or g
  modified_base (121): a, t, c or g
tccatcacccgatgtggcnggagcactgccatgtcgatctcaactaccacctccggccgtggcggttgcgcgccccggggggtccgcgcgaactcgacgaggcggtcggagaaatcgccancaccccgctgaaccgcgaccacccgctgtgggagatgtacttcgttgaggggcttgccaaccaccggatcgcggtggttgccaaaattcaccatgcgttggctgacggtgttgcctcggcaaacatgatggcacgggggatggatctgccgccgggaccggaggtcggccgctatgtgcctgaccccgctcctaccaagcggca

SEQ ID NO: 43 - DNA, 221 bp, Mycobacterium tuberculosis
agctttgcagttgctgagtaatgtcggccaacgtcaccacaaccgcgatgaattcaatcatgccgcccagggcggccaacccaatggtggccgcgagcggcagctcgatcgcagcgcggaggttgccggccgccagttgattcacgaacagggtgaggtcataggcgggcaggatagtgacgaaggcaagacctccatctgccgtcggaagaagtatcgag

SEQ ID NO: 44 - DNA, 285 bp, Mycobacterium tuberculosis
agcttcagaacaggcctgttgtgggcgcacccggctcgccgagttctgcacgcaccgcctcaagtgcggcccgcaccgccggcatctcccggtcacgcagggccgcggcccgcgccgcagcgacggcgtgttcgcgcagttcgccgtcaatgatgctgacctgatcggccacccgggcgttctcggcgtcgtcgcgttcactaatcgcggtgctcagcagcgtctcgacagccaccacccgagtggcgaccagctgctccaccacggaccgcagcgatgcccgtc

SEQ ID NO: 45 - DNA, 179 bp, Mycobacterium tuberculosis
atactcaagcttcagttcctccacgacgcgttcccaaatgaatttcccgatcccacaatctcggttcagatacaggtcgccataccccttacttcggcaacgctgggcggattggccctgccgctgcaccaaaccatcaacgccttcaaattgccggcaatctcgttcagccaatccat

SEQ ID NO: 46 - DNA, 315 bp, Mycobacterium tuberculosis
  modified_base (125): a, t, c or g
  modified_base (155): a, t, c or g
gctctacgccgcctacgggtcgaacatgcatcccgagcagatgctcgagcgcgcaccccactcgccgatggccggaaccggctggttacccgggtggcggctgacgttcggcggcgaggacatcngctgggaaggggcgcttgccaccgtcgtcnaagacccaaattcgaaggtgttcgtcgtgctctacgacatgaccccggcggacgagaagaaccttgaccggtgggaaggctccgagttcggtatccaccagaagatccgatgccgcgtggagcgcatttcctcggacaccacaacgggatcccgtcctcg

SEQ ID NO: 47 - DNA, 285 bp, Mycobacterium tuberculosis
atactcaagcttgccaaagagacctcgtccaccaagcaggacgcgaccgtcgaggtggcgatccggcttggcgtcgacccgcgtaaggcaaaccagatggttcgcggcacggtcaacctgcccacaccggcactggttaagaactgcccgcgtcgcggttttcgcggttggtgaaaaggccaatgcctgcgtttgccgtgggggcggatgttgtcgggagtgacaatctgatcaaaaggattcagggcggttggctggaattcaatgccgcaatcgcgacaccgg

SEQ ID NO: 48 - DNA, 369 bp, Mycobacterium tuberculosis
  modified_base (364): a, t, c or g
ccacggcgtggatcaaggtaccggccgggatgttgcgcaatggcaggttgttgcccggcttgatgtcggcgttagcgccggattccaccacatccccttgcgaaagtccgttgggtgcaatgatgtagcgcttctccccatcgagatagtggagcaacgcaatccgtgcggtacggttcgggtcgtactcgatgtgcgcgaccttggcgttgacaccatctttgtcattgcggcgaaagtcgatcatccggtaagcgcgcttatgaccgccgcctttgtgccgggtggtaatccggccatgcgcgttgcgtccaccgcgacgtgcagcgggcgcaccagcgacttctccggggttgaccgggtnatctc

SEQ ID NO: 49 - DNA, 461 bp, Mycobacterium tuberculosis
  modified_base (89): a, t, c or g
  modified_base (117): a, t, c or g
  modified_base (183): a, t, c or g
  modified_base (353): a, t, c or g
gcagcatgacggcggtagcgaacaccgccggatgcagcgcaagtagcgtcgatgtgctcacggaatcgccccggcaccgcgatctcgangatcaccagtgccaccccctgcagcgcnacaccgacgattccgtacaccgccacgccgatcaggccctgggccatctgattggagctggcgtanatggcggcgatggtgacgatggccagcgccacatacattgtggcggccagaaccacggcgttggggcggcggtcgatgaacactaggcgacgcagatcgcccggggtcaacaggttgaccatcagaaagcctgcgactagcacggcggcgccactaggaagtacaagaangtggccaccaccccatgcaggatcggggtaaggctgatggtcccgaaatcgactccggcctaatacatgactctctcctttgcgtcatcgccttacttgtgcgcggaa

SEQ ID NO: 50 - DNA, 127 bp, Mycobacterium tuberculosis
  modified_base (24): a, t, c or g
  modified_base (118): a, t, c or g
  modified_base (120): a, t, c or g
gggacacacctcgatgctgccgcnatggacgcggtcgaacgcaagcagctgatcgagctacaacgccgcgcggaacgcttccgccgcgggcgtgacgcatcccgttgaccggccggancnctctcta

SEQ ID NO: 51 - DNA, 305 bp, Mycobacterium tuberculosis
  modified_base (24)..(25): a, t, c or g
  modified_base (34): a, t, c or g
  modified_base (39): a, t, c or g
tgggcgcctctttcggccttcccnntttaaacgnagcangacattctgggtatcgagttgtactggatggtgttggcgatgtcggtgatcctgctcctggcggtgggatccgactacaatctgctgctgatttcccggttgaaagaggaaattggggccggattgaacaccggaattatccgtgccatggctggtaccgggggagtggtgacggctgccggcatggtgttcgccgttaccatgtcgttgtttgtgttcagcgatttgcgaattattggtcagatcggtaccaccatcgccttccc

SEQ ID NO: 52 - DNA, 449 bp, Mycobacterium tuberculosis
  modified_base (16): a, t, c or g
  modified_base (29): a, t, c or g
  modified_base (80): a, t, c or g
  modified_base (108): a, t, c or g
  modified_base (407): a, t, c or g
  modified_base (436): a, t, c or g
  modified_base (439): a, t, c or g
  modified_base (443): a, t, c or g
ccgatcggcgccgcanctggttggtgttncggatgaatccgcagcgaaaatgtagctgcggtggcgtgtcgtgactcgtnggcgtcgacgctcgtggcagccaccgancggttggtccaggatctggatgggcaaagttgtgcggcccggccggtgacggccgatgagctgaccgaggtcgacagcgccgtgttggctgacttggaaccgacatggagtcgccccggttggcgtcacctcaagcatttcaatggttatgcgaccagtttttgggttacgccgtcagacatcacgtcggagacttggatgagctgtgtctgccagatagccccgaatcgggacgaccgtggtcacggtgcgtctgaccactcgggtcgggtcgcccgcgctatcggcatgggtgcgtnatcacagcgacacgcgcctgcccaaggangtncggncggacc

SEQ ID NO: 53 - DNA, 160 bp, Mycobacterium tuberculosis
  modified_base (155): a, t, c or g
cgggttgcggatccacgcgtgcgggttgtcagcagctacggcactgaaccgcgcccacagctcgccgatccgctttcggtggttctcgatcgactcgccgtaggcgatgcgcagcgcctgctcgaatatcgggtacacgtaggccggccttcccncttta

SEQ ID NO: 54 - DNA, 308 bp, Mycobacterium tuberculosis
cttgattttgatcatcatgacgatcatcaccctaattttgctacccgcactggttatcgtgggtaccgtcgtgctttccatgggcgcctctttcgggctttccgtattggtctggcaggacattctgggtatcgatttgtactggatggtgttggcgatgtcggtgatcctgctcctggcggtgggatccgactacaatctgctgctgatttcccggttgaaaaaggaaattggggccggattgaacaccggaattatccgtgccatggctggtaccgggggagtggtgacggctgccggcatggtgt

SEQ ID NO: 55 - DNA, 460 bp, Mycobacterium tuberculosis
  modified_base (239): a, t, c or g
  modified_base (337): a, t, c or g
  modified_base (379): a, t, c or g
  modified_base (391): a, t, c or g
  modified_base (398): a, t, c or g
ggggatccctagatcgacctgcaggcatgcaagcttggcgtgtcgttccaacccgaattggctttcggcgccatcggtgaggcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcnactgtcaaggcggcgtgccaggtcgcccgggcgcacggtgcggacaaggtggtgctggcggtcccgatcggcccagacgacatcgtggcgagattcgncgggtacgccgatgaggtggtgtgtttggcgacgccggcgtngttcttcgccgncgggcanggttaccgcaacttcacccagacctccgacgacgaggtggtggcgtctcctggatcgtgctc

SEQ ID NO: 56 - DNA, 299 bp, Mycobacterium tuberculosis
  modified_base (21): a, t, c or g
  modified_base (171): a, t, c or g
aaggctgcaggtcgaagcggntggttacgactccctgtgtgtgatggaccagttctactatctgcgtctacacggcccttggtgcgctggccacggcgaccgagcggctgcaactgggcgcgttggtgaccggcaatacctaccgcagccccgaccctgctggcaaagatnatcaccacgctcgacgtggttagcgccggtcgagcgatcctcggcattggagccggcgggtttgaactggaacaccgccagctcggcttcgagtccggcacttccagtgaccggttcaaccggctcga

SEQ ID NO: 57 - DNA, 373 bp, Mycobacterium tuberculosis
  modified_base (106): a, t, c or g
  modified_base (305): a, t, c or g
  modified_base (339): a, t, c or g
  modified_base (373): a, t, c or g
ctttccgcggtacccgctcaactttgtgtcgaccctcaacgccattgccggcacctactacgtgcactccaactacttcatcctgacgccggaacaaattgacgcngcggttccgctgaccaatacggtcggtcccacgatgacccagtactacatcattcgcacggagaacctgccgctgctacagccactgcgatcggtgccgatcgtggggaacccactggcgaacctggttcaaccaaacttgaaggtgattgttaacctgggctacggcgacccggcctatggttattcgacctcgccgnccaatgttgcgactccgttcgggttgttccagangtcagcccggtcgtcatcgccgacgctctcgtcn

SEQ ID NO: 58 - DNA, 338 bp, Mycobacterium tuberculosis
  modified_base (309): a, t, c or g
  modified_base (328): a, t, c or g
cggtcatagccctcgggtccggccagcactccgcaggcttcgtcggggtggtcgcgacgcgcatgggccaccatcgcattcaccaggtctgcgcgaatcaccagcacgtagacggttcctttcctaagcaacaccgaagtttcacgacccgaatgctccgggaaacatgtcacggtaggtcggtattccggctaccggctgagcattgagcacgccggccagcaccgcacgagccaggcaatcagccgccgccgcaccgatcgcggtgaccagctgagtctccggagacaatgcggccggcacgccggnctccggcggcaccgctacngcgcccgtgg

SEQ ID NO: 59 - DNA, 374 bp, Mycobacterium tuberculosis
  modified_base (40): a, t, c or g
  modified_base (134): a, t, c or g
  modified_base (139): a, t, c or g
  modified_base (336): a, t, c or g
gtgatggcacgccaccgcgacaccacccggctgcgctacntcgagccataccgggcggagctacatcggctcggccgcccagtgttcgggccctctttcgaggtcgaggtcgataccgatttgcgcatccgcanccgcnccctggacgacagaaccgtgccctacgagtgcttgtcgggcggggccaaagaacagcttggcatcctggcgcgattggccggcgcggcgctggtcgccaaggacgacgccgttccggtgctgatcgacgacgcgctggggttcaccgatccggagcgactatcaagatgggggaggtctctgacaccatcggccccnacggacatgtgatcgtgccgacgtgcagtcccaccccg

SEQ ID NO: 60 - DNA, 448 bp, Mycobacterium tuberculosis
  modified_base (154)..(155): a, t, c or g
  modified_base (322): a, t, c or g
  modified_base (334): a, t, c or g
  modified_base (347): a, t, c or g
gcgaaagtccgttgggtgcaatgatgtagcgcttctccccatcgagatagtggagcaacgcaatccgtgcggtacggttcgggtcgtactcgatgtgcgcgaccttggcgttgacaccatctttgtcattgcggcgaaagtcgatcatccggtnngcgcgcttatgaccgccgcctttgtgccgggtggtaatccggccatgcgcgttgcgtccaccgcgaccgtgcagcgggcgcaccagcgacttctccggggttgaccgggtgatctcggcgaaatcagatacgctggcgccgcgacgaccaggcgtcgtgggcttgtncttgcgaattgncatgtctaatcangtctttctctcacgctctcgtcgccgggctaggccgcattgccctgctcctcctcatcgcttcgctctgcatcgtccccgggctaagcccgtgccccgaaa

SEQ ID NO: 61 - DNA, 356 bp, Mycobacterium tuberculosis
  modified_base (349): a, t, c or g
gatggttcgcggcacggtcaacctgccacacggcactggtaagactgcccgcgtcgcggtattcgcggttggtgaaaaggccgatgctgccgttgccgcgggggcggatgttgtcgggagtgacgatctgatcgagaggattcagggcggctggctggaattcgatgccgcgatcgcgaacaccggatcagaatggccaaagtcggtcgcatcgctcgggtgctgggtccgcgcggcctgatgcccaacccgaaaaccggcaccgtcaccgccgactccccatggcgtcccggatatcaagggccggcaaatcaacttcccggttgatcagcaaggcaacctgcctccncctccgg

SEQ ID NO: 62 - DNA, 336 bp, Mycobacterium tuberculosis
  modified_base (323): a, t, c or g
atactcaagcttcgtcataagaccatggtgcgctttctttcacccgtccagagtcgggggcatccgcaccggctcgcatcgcatcatcctcccacgacgggccgctcatcagcttgggccatttcaatgtacttgataccccgcgctgcgggtaggccactgcgacaattcaaacacggtgtcacacggtgaatagtgtcgagatgggctctgatcaaccgtcgcaaacccggtttcgcatcaatagcggaatcccaccgggttgcatggaggctgctgaccttggaaaacaaaattttttcattacaacaaaacaaccgccncggaaactttgca

SEQ ID NO: 63 - DNA, 489 bp, Mycobacterium tuberculosis
cgaattcggcgtgcaccgctatgggttgcagcagcggctggcgccgcacaccccactggcccgggtgttttcgccccgaacccggatcatggtgagcgaaaaggagattcgcctgttcgatgctgggattcgccaccgcgaggccatcgaccgattactcgccaccggggtgcgagaggtgccgcagtcccgctccgtcgacgtctccgacgatccatccggcttccgccgtcgggtggcggtagccgtcgatgaaatcgctgccggccgctacctgcaaggtgattctgtcccgttgtgtcgaagtgcctttcgcgatcgactttccgttgacctaccggctggggcgtcggcacaacaccccggtgaggtcgtttttgttgcagttgggcggaatccgtgctctgggttacagccccgaactcgtcacggcggtgcgcgccgacggagttgttatcaccgatccgttggccgtaccgcgccttgggc

SEQ ID NO: 64 - DNA, 448 bp, Mycobacterium tuberculosis
  modified_base (160): a, t, c or g
  modified_base (377): a, t, c or g
  modified_base (423): a, t, c or g
  modified_base (428): a, t, c or g
  modified_base (448): a, t, c or g
tcagactccacccagccagcaggcagcgcgaagctgaatcctccaaccgggttgtcgatccggacaggttggggtgcgtttggggcaatgacaggtggcggcggtgcgttcgggtcggccggcggaggtgctgcgttgggatcgcccggctgggcattcngcgtgttggcggcggccggtggtgggggggcaacaggtgtcgccggtgcgggtggcgctgcagcggtcgacggcggcgaagcggccgttgtgggtaccgggggcgctggctccggatcggcgttggcggtcgcgggcaccgcaacggtcaccaagctggcgctggccatcgccgcgatagccagtgccgccaatcgtcccttgcgacgtgtcaagtnggggtccacctgatgcatggccaaagaacctaccgtgttaacggcncaacncaaggaccgcgccggtcgcn

SEQ ID NO: 65 - DNA, 346 bp, Mycobacterium tuberculosis
  modified_base (30): a, t, c or g
  modified_base (63): a, t, c or g
  modified_base (153): a, t, c or g
  modified_base (155): a, t, c or g
  modified_base (162): a, t, c or g
  modified_base (302): a, t, c or g
  modified_base (313): a, t, c or g
tttccgcggtacccgctcaactttgtgtcnaccctcaacgccattgccggcacctactacgtncactccaactacttcatcctgacgccggaacaaattgacgcagcgggtccgctgaacaattcggtccgtcccacgaaagaaccagttttncntctttcncacggagaacctgccgctgctagagccactgcgatcggtgccgatcgtggggaacccactggcgaacctgtgtttcaaccaacacttagagtgtaattgtaaacctgggctaggggaaaccggctctagtttttccaccntctccgccccntgtttcgaatactccgttcgggttgtccccaaa

SEQ ID NO: 66 - DNA, 277 bp, Mycobacterium tuberculosis
gcttccggctcgtatgttgtgtggaattgtgaccggataccaatttcacacaggaaacagctatgaccatgattacgccaagctagttaggtgacactatacaatactcaagcttgccggctggtgggccgaccacttcgatggcacgacccgtgaactgctgcccggccaattcttcttggtcgcccggaccgatggaccgcggctgggattccagaaggtgcccgatcccgcccctgggaaaaaccgcgtgcacctctacttcacgaccaacgac

SEQ ID NO: 67 - DNA, 434 bp, Mycobacterium tuberculosis
ccgatcgactgatgcgccgacaaccacgccccaacaactggaatgaaccgtcgtgaccatcatcagcacgcggttgtaggcgacttgcgacatgttcaacccgccgtactcggacggaatcttcaaaccgaaacagcccagctcggccaggcctttcacgtactcgtcggggatctgggcaccacgctcgaggacgctgccgtccacggtgtctaggaattcccgcagtttgaccagaaacgcctcggttcgggcctcctcggcgtccgacggcttgggaaatgggtgtatgagccctacgggaaaccggcccacaaagagttctttggcgaaggacggtttatcccaaccactttcgcgagattcctcggcaagggcccgcgcttgctcctcggtgacctgagtttgctgtgccatcgccgcctcctccctga

SEQ ID NO: 68 - DNA, 465 bp, Mycobacterium tuberculosis
tgcatccggctcgtatgttgtgtggaattgtgagcggataacaatttcacacaggaaacagctatgaccatgattacgccaagctatttaggtgacactatagaatactcaagcttttacggtgatcgcgcatcacctggttcatgaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacagcgcgttctccaccgaccgggcccgggtgtggggtgtttcggcgaccggcagccaggtggtccacactgccgacgggcgccgcgagccgttcaccgaccaggccgccgagcaagtccgcccgatcgcatactcc

SEQ ID NO: 69 - DNA, 463 bp, Mycobacterium tuberculosis
gggggcgctgctggtatagtcgctgaccggtgcaggtttcgacaatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtcggctcggatagcgaggtcagcgaattctcgtggcagctcgaaagggtcctgccggtgccggtctttgcgcaaacgatggcgcaggttacggtcgcgcggggtgcggcctggcggcggccagagcacgagttcaccgatgcgcagctagtggcgacagcgtcagccaac

SEQ ID NO: 70 - DNA, 447 bp, Mycobacterium tuberculosis
tgcttccggctcgtatgttgtgtggaattgtgagcggataacaatttcacacaggaaacagctatgaccatgattacgccaagctatttaggtgacactatagaatactcaagcttccgtacaggtcgcctccaacacggcggggaagcgacaccagcctaccgagcttggagtccaggacgccagcggcggcgtcggtctgcgtcgtggtgccgccggggtggcgttggctggcaacgatctccacccagccggtcgggttacccacgatctcggcatagacgcgggccgaggccggtgcgataccgtattgcgtcaattgggacgcggttgtgcattcggctagctcggttgccacacccgtcaggggttcgacgttggcgggttcggcgggccccagcaccgctgtcaccatgcccgccaagccgacctgcggcgccaccaact

SEQ ID NO: 71 - DNA, 460 bp, Mycobacterium tuberculosis
  modified_base (403): a, t, c or g
cggcatgaccaccgacaggcccgactggtcgtaccactcgaacgccggggtgttgatgtcccagccgctgaagtcgtcctgcgcgcgcaggccgtcgagcaggtacagggcgggcgagttggcaccaccactttggaattggaccttgatgtcacggcccatcgacggcgacggcacctgcaggtactccaccggcaagcccggccgggaaaatgcccccgcggtcgccgtgccaccgacggcgccgaccagacccgacactagggccgcgccgacggccccgaccacgagtcgacgcgacatacccgtgacggcgccacgaaccctgtcaacaagctgcattcttgcttccctcatcctcatctcaacgcatccatgcatgtttgggcgcatcctgaattangtcagactgcaggcgctgggccggcagtgctcgtgtatcaaccacaacttcgggcgt

SEQ ID NO: 72 - DNA, 404 bp, Mycobacterium tuberculosis
ttccaaccctaattggctttcggccccatccgtgaggacggggtgcgggtgctcaacaacaacgtcgtccgcgggacacacctctatgctgccgccatggacgcggtccaacgcaagcagctgatcgagctacaaccccgcgcggaacgcttccgccgcgggcgtgaccgcatcccgttgaccgggcggatcgcggtgatcgtcgatgacggcatcgccaccggagcgacggccaaggcggcgtgccacgtcgcccgggcgcacggtgcggacaaggtggtgctggcggtcccgatcggcccaaacgacatcgtggcgagattcgccgggtacgccgatgaggtggtgtgtctggcgacgccggcgttgttcttcgccctcgggcagggttaccgcaacttcac

SEQ ID NO: 73 - DNA, 465 bp, Mycobacterium tuberculosis
  modified_base (298): a, t, c or g
caggcatgcaagctttccgccgatacccgccatgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggagacaaaagtatcgctaaggtcaccgccgatcacnagcatggtgatcgcagcaatgttgctagtgatctatcgctccgtaattaccgcggttctcgtcttgatcatggtcggcatcgactcggccaatccgcggattcatcgccttgctcgccgaacacaacattttcacctttcacatttgcaccaacctgctcttctcat

SEQ ID NO: 74 - DNA, 387 bp, Mycobacterium tuberculosis
  modified_base (19): a, t, c or g
  modified_base (76): a, t, c or g
  modified_base (197): a, t, c or g
  modified_base (387): a, t, c or g
cactactcaagctctctcntcattaccacccctgtaatttgggatgggcaaaaaggcgaagcaccgcttggccacnaacgccgggagggacaatctcgggcggctatggcttctcccgggaaggccccaacgtacggcgtttcaacacgtcgcgtcgccctccgaccgcgaacattcggggattggcaccaacctgntaccaccctggccgggcgatgatctgcagcgtcgccgcgggtagtccccgcccgggcggctacagtctgaaaccccgatgaccatcgatgtgtggatgcagcatccgacgcaacggttcctacacggcggatatgttctcctcgctgcgccggtggaccggtgggtctatcccctgaaaccgacatcccn

SEQ ID NO: 75 - DNA, 445 bp, Mycobacterium tuberculosis
caggcatgcaagctttcgtcagttcattgcgccagcagaccaacaagagcatcgggacatacggagtcaactacccggccaacggtgatttcttggccgccgctgacggcgcgaacgacgccagcgaccacattcagcagatggccagcgcgtgccgggccacgaggttggtgctcggcggctactcccagggtgcggccgtgatcgacatcgtcaccgccgcaccactgcccggcctcgggttcacgcagccgttgccgcccgcagcggacgatcacatcgccgcgatcgccctgttcgggaatccctcgggccgcgctggcgggctgatgagcgccctgacccctcaattcgggtccaagaacatcaacctctgcaacaacggcgacccatttgttcggacggcaaccggtggcaacgcacctaagctacttgcccgggatga

SEQ ID NO: 76 - DNA, 345 bp, Mycobacterium tuberculosis
gtttatgcactggttaggtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacacgtacacaaggagataagaagagcacatacctcagtcacttattatcactagcgcccgccgcagccgtgtaaccgagcatagcgagcgaactggcgaggaagcaaagaagaactgttctgtcagatagctcttacgctcagcgcaagaagaaatatccaccgtggggaaaaactccaggtagaggtac

SEQ ID NO: 77 - DNA, 139 bp, Mycobacterium tuberculosis
  modified_base (37): a, t, c or g
atactcaagcttgggtgtagccgatcaccggaagtcncatgatcagccacgttccgcgccgcccggcatacggtggtgtaccgatctccgcgtcatacacccgcgggtaatcgccgacggtgccggttcgcgagccgaa

SEQ ID NO: 78 - DNA, 298 bp, Mycobacterium tuberculosis
agctttatcgaaagcgcgaacagctcgcggcggcccacgacgtgctgcgtcggattgccggcggcgagatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccatcgtgatcaggctcggctcgcgagttcggcgaagaaatggttcgcctgatcacctaccatcggcca

SEQ ID NO: 79 - DNA, 300 bp, Mycobacterium tuberculosis
  modified_base (58): a, t, c or g
  modified_base (273): a, t, c or g
tcaacacgccgccagccaccacgcgcgggtcgggcgccgggcccgggcctccaggctnctccgctcggtgatggcacgccaccgcgacaccacccggctgcgctacgtcgagccataccgggcggagctacatcggcccggccgcccagtgttcgggccctctcgcccaggtcgaggtcgacaccgatttgcgcatccgcagccgcaccctgcgacgacagaaccgcggccctacccactgcttgtcgggcgggggccaaagaaccagcttgncatcctgccacaattggccggcgcccg

SEQ ID NO: 80 - DNA, 321 bp, Mycobacterium tuberculosis
caggcatgcaagcttcacgtccgtacggctcgggtacgcttcggtcgcagtgtgcgagtgatagatgacgaccgggacctcgtcggcatcttccatagcccgccacaccttcagttgctcaccggaatccaaccggtagaaggtcggccagcgctcggcattggtcatcgggatatgccgctcgggacggtcagagccctcgggtccggccagcactccgcaggcttcgtcggggtggtcgcgacgcgcatgggccaccatcgcattcaccaggtctgcgcgaatcaccagcacgtagacggttcctttcctaagcaacac

SEQ ID NO: 81 - DNA, 340 bp, Mycobacterium tuberculosis
  modified_base (29): a, t, c or g
  modified_base (164): a, t, c or g
  modified_base (174): a, t, c or g
aatattcaagctttcggcggaaacggacnccttgcgaacattgataacaaaatagaaatcattgatggtttgagtcaccaggccgatcaagccttcgccgagccaaattccaatcaagaggcccaagcccgtaccaatcagcccggcaacgagggattccgtcnttatcagccnaaataactgctctcgggtaccacccaaacagcgcaatatggcgaaaaacggtcgccgttgcacaacattaaatgtctcggtattgttgattaaaaagatacccaccaccagggcaatccaactgagagcggttaaattgaccgtaaaaacctcccgtcatctgttt

SEQ ID NO: 82 - DNA, 394 bp, Mycobacterium tuberculosis
  modified_base (379): a, t, c or g
caggcatgcaagcttgctgcatcttcctgtgactgctcccgaaacctgggggtgtgcctgctgtgtatgcacggcatacggacatccttcccctgatacccgcggtcgaaccagccacgtgtccatcatcaggggtcaaccccggccaagggcgacggcacgccaagttcgccgaccgttaacctagtgctgttagcttcatttgctgcgagcaaaacagctggtcggccgttaggaactgaattgaaactcaaccgatttggtgccgccgtaagtgtcctgtctgcgggtgcgctggtgttgtccgcgtgtggtaacgacgacaatgtgaccgggggaggtgcaaccactggccaggcgtccgcgaaagtccattgcngggggaagaagacac

SEQ ID NO: 83 - DNA, 487 bp, Mycobacterium tuberculosis
gaaagtgccccaaggtgttggtgaaactcgctggacggtccccaggatgttggcagcacattcaccggacatgaccggagcaagaccggacatcctcccataccgtcgtcgccgtgtacatccgtagcccgtcctggcaggtgctgggttgaacaaaatcagcccaacacctgccacgacgaagaagcgggttgcgctggcatgtcttgtcggctcggcgatcgaattctacgaattccttatctacgggaccgctgcggcgctggtgtttcccaccgtgttcttcccacacctggatcccacggtggccgccgtggcctccaaggggacatttgctgtggcgttcctatcccggccgttcggcgcggccgtctttggatactttggagaccgcctcggccgccagaagaccctggtcgccacactgttgatcatgggcctggcaaccgtgactgttgggctggttccacgacagtggccatcgcgc

SEQ ID NO: 84 - DNA, 418 bp, Mycobacterium tuberculosis
  modified_base (37): a, t, c or g
  modified_base (263): a, t, c or g
atattcaagctttgtcacaccaagtgttccgaccaancgctccatccggcgagtggatactcccagcaggtagcaggtcgccaccacgctggtcagtgcgcgttcatctcgcttgcggcgctgcagcagccagtccgggaaatagctgccctggcgcagcttggggatcgcgacgtcgatggttgcggcacgggtgtcgaaatcacggtggcggtagccgttgcgctgattggaccgctcatcgctgcgttcgcggtagcccnccccgcacagggcgtcggcttcagcccccatccaaggcggcgatgaacgtcgagagcagcccgcgcagcaaatccgggctcgcctgtgcgagttggtcagccagaagctgctcggtgtcataagatgagaagaggtcagtgcgtcctttccttcg

SEQ ID NO: 85 - DNA, 399 bp, Mycobacterium tuberculosis
caggcatgcaagctttttgagcgtctcgcggggcagcttcgccggcaattctactagcgagaagtctggcccgatacggatctgaccgaagtcgctgcggtgcagcccaccctcattggcgatggcgccgacgatggcgcctggaccgatcttgtgccgcttgccgacggcgacgcggtaggtggtcaagtccggtctacgcttgggcctttgcggacggtcccgacgctggtcgcggttgcgccgccaaagcggcgggtcgggtgccatcatgaatgcctcaccgccgccgcactgcacggccagtgccccggcgatgtcagccatcgggacatcatgctcgcgttcatactcctcgaccagtccgcggaacagctccattcccggaccgcccaacgc

SEQ ID NO: 86 - DNA, 474 bp, Mycobacterium tuberculosis
  modified_base (71): a, t, c or g
  modified_base (139): a, t, c or g
atactcaagcttttggctgggtcgccttccaattcagcgtgcaccgctatgggttgcagcagcggctggcnccgcacaccccactggcccgggtgttttcgccccgaacccggatcatggtgagcgaaaaggagattcncctgttcgatgctgggattcgccaccgcgaggccatcgaccgattactcgccaccggggtgcgagaggtgccgcagtcccgctccgtcgacgtctccgacgatccatccggcttccgccgtcgggtggcggtagccgtcgatgaaatcgctgccggccgctaccacaaggtgattctgtcccgttgtgtccaagtgcctttcgcgatcgactttccgttgacctaccggctggggcgtcggcacaacaccccggtgaggtcgtttttgttgcagttgggcggaatccgtgctctgggttacagccccgaactcgtcacggcggtgcgccgccgac

SEQ ID NO: 87 - DNA, 383 bp, Mycobacterium tuberculosis
caggcatgcaagcttcaacctattgacgcattgtgcgaactgacggcgcccgcgcatggccaatccggaagaccatcattggccagtggccgggcgctaacaggttccagccccccaccagtgccgctcgaacatgcggtgcaacccattcgcaggccggcagggaaagcaccgcggaagccgcaaagggctgcagttccgcgcccaatagtgtcgtccgcaaccagatgcgctcgaaaaccgccgccggcagtcagcgcacccgacgcgaggtcgagagacgtcgtcagcgcgcccacatggggtgccaatcggcacggcaggtaggccgcgcgcaaccccaacgcgtggtgcatgccacggtccgcaggaggccaccaccc

SEQ ID NO: 88 - DNA, 455 bp, Mycobacterium tuberculosis
  modified_base (70): a, t, c or g
  modified_base (249): a, t, c or g
atactcaagcttcccggccgcaggtgacggcgcggcctagcgccacttgatgccgcacccgatcgacggncgttggtcggggttgactggccgcccggcgagcagggcgtcaaccgcggcccggacgtcggcggccgtcaccggtcggccattgcccgggcgggagtcgtcgagctgaccacggtagacaagtcggcgctggccgtcgaagacaaacgtgtcgggtgtgcaggccgcggagaaggcgcnggcgacgtctcgggtttcgtcgtagagatacgggaacgtccagccgtggcggcgggcctcggcgaccatctgatcgggcccgtcctgcgggtaggtgaccacgtccttactggagataccgaccatcgggaccctttgatcggcgaggtcccggccgaccgtggccaatccggcggcgacgtgtcgcccgtaccggccagtggttc

SEQ ID NO: 89 - DNA, 429 bp, Mycobacterium tuberculosis
  modified_base (18): a, t, c or g
  modified_base (21): a, t, c or g
  modified_base (88): a, t, c or g
caggcatgcaagctttancancatcaaccccgccccgcaccagcaccgacacgatgtcgatgccatcgaggtgaatgtcgaactggcncaaaccatctggcgaccgcgaccaccggcaacatgggtaccggcgatttccggtgccaatgccgacccgacgggccgctctcaccgcaggtgacctcgatcaccgagaccagccggccgttatactcacgcacccctaccgtgtcacgcccaaaacggcgctggtggtcgattgccggagtgcaccccgcacccagtgtcgtgcccggatccgccgaccaatcccgcacccacgtcgccaaacccgaaatcaccgtgatgccgtggtaactgaccaccgacagtaacgtcactacggccgccacgccgacgccgaaccaccacgcacatgatgatcggctg

SEQ ID NO: 90 - DNA, 321 bp, Mycobacterium tuberculosis
  modified_base (93)..(94): a, t, c or g
  modified_base (96): a, t, c or g
atattcaaccttgcacacattgacgataccttggtcacgagaccccaaaagctggcctccaccgcgcgccggggaccacggtcataccttganncngctttcgatcgttgatgctgcgtcttggtccgcggaaaccgcaggctggcatatgcacgtgggcgcactggcgatctgcgatccccaccgattcgcccgaatacagctttcagcggctccccaagttgatcatcgaccggctgccggatatcccgcacttgcggtggcgggtcaccggcgccccgctcggactggaccggccgtggttcgtcgaggaccacgaac

SEQ ID NO: 91 - DNA, 134 bp, Mycobacterium tuberculosis
caggcatgcaagcttcatgcccgcggcatgatagccacatgcacgcaatcgaactcagcgaaaccggcgggccaggcgtcttacgccacctcaccagcgcgcaacctcaacccggccacggagacctcctgatc

SEQ ID NO: 92 - DNA, 513 bp, Mycobacterium tuberculosis
  modified_base (185): a, t, c or g
atactcaagcttgattttgatcatcatgatgatcatcacccgaattgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcntggcggtgggatccgactacaatctgctgctgatttcccggttgaaagaggaaattggggccggattgaacaccggaattatccgtgccatggctggtaccgggggagtggtgacggctgccggcatggtgttcgccgttaccatgtcgttgtttgtgttcagcgatttgcgaattattggtcagatcggtaccaccatcggcctgggcttgctgttcgacaccctcgtcgtgcctcgttcatgaaaccgtccattgctgccctgctgggacctggttctggtggccgctacgggtgcgcccgcgcccggcagtcaaatcttccgccg

SEQ ID NO: 93 - DNA, 345 bp, Mycobacterium tuberculosis
caggcatgcaagcttggcgtgccgttccaacccgaattggctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaacgtggtgctggcggtccccatcggcccagacgacatcgtggcgaga

SEQ ID NO: 94 - DNA, 302 bp, Mycobacterium tuberculosis
  modified_base (283): a, t, c or g
atactcaagcttttacggtgatcgcgcatcacctggttcatgaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacagcgcgttctccaccgaccgggcccgggtgtggggtgtttcggcgaccggcagccangtggtccacactgccgaag

SEQ ID NO: 95 - DNA, 286 bp, Mycobacterium tuberculosis
  modified_base (28): a, t, c or g
  modified_base (189): a, t, c or g
  modified_base (191): a, t, c or g
tagtcgctgaccggtgcaggtttcgacnatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtctancntgtgtgccgcggattatcaggactgacctcctggctgaccggcatgtttggtcgcgatgcctggcgcccggccggcgtggtcgtggtcggctcgg

SEQ ID NO: 96 - DNA, 482 bp, Mycobacterium tuberculosis
  modified_base (400): a, t, c or g
  modified_base (476): a, t, c or g
atactcaagctttccgccgatacccgccatgtcgcgcacatccagaacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggagacaaaagtatcgctaaggtcaccgcgatcacgagcatggtgatcgcagcaatgttgctagtgatctatcgccccgtaattaccgcggttctcgtcttgatcatggtcggcatcgacctcggcgcaatccgcggattcntcgccttgctcgccgaccacaacattttcagcctttcaacatttgcgacaacctgctcgttctcatggcgattgcngcgaac

SEQ ID NO: 97 - DNA, 395 bp, Mycobacterium tuberculosis
caggcatgcaagcttggcgtgccgttccaacccgaattggctttcggcgccatcggtgaggacggcgtgcgggtgctcaacgacgacgtcgtccgctggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccagacgacatcgtggcgagattcgccgggtacgccgatgaagtggtgttgtttggcgacccggcgttgtt

SEQ ID NO: 98 - DNA, 439 bp, Mycobacterium tuberculosis
atactcaagctttggcattgtgcacattttccacccgtgctctattaatgctgagccgctaattgtgaccccagtcgggaaacacgcggagcaccaaattcaccgcagcggccggggcggttcaactcaccatggatcgctctcgtcgtctggtgctggacaatcgtcgctgtagcgcgtcgcgaacacctcagcttctgctgccgcggcttcttccggcgatggtaacccccaggtttcgcccacggtcttacgtagcagtgcgacgcggtgttcatctgcatcgacctgttgactcatcctgtcaaggatgaaggcgtactgggccgactgcgccttctgccgcgccaggtcggcaatcaccaggatctcagaaacgagctgcgactcactcttccaggccaccctggccgaaagctcgacatggtcaatccggccg

SEQ ID NO: 99 - DNA, 348 bp, Mycobacterium tuberculosis
caggcatgcaagcttgcgggccggagtggtttcgacggccgctcgcttctcggcatcggtttgggctgtcaccagcagttggtagttcttcacgtactgttgttcgagcgtcgagccgccgcgcgtgtcgaggtcgccggacgcgtatcccgccaggccggtcagggtgcccttccagtccacgccgctgtggtcggcgaaccgcttatcttcaatcgagacgatcgccagcttcatcgtgttggcgatcttgtccgagggcacctcgaaccggcgctgcgagtacagccacgcgatcgtgttgcccttcgcgtcgaccatcgtcgataccgcaggcacttgcccctc

SEQ ID NO: 100 - DNA, 436 bp, Mycobacterium tuberculosis
atactcaagcttcccggcggccagtaccgaaagcgcgaacagctcgcggcagcccacgacgtgctgcgtcggattgccggcggcgaaatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccagcgtgatcaggctcggctcgcgagttcggcgaagaagtggctcgcctgatcacctaccatcggccaggatctgcgtgtcatcacaacgctcgccaaggaggttgttgtggtgctatcgacggcctttagccagatgttcggaatcgactatccgatagtgtccgcgccaatggacttgatcgccg

SEQ ID NO: 101 - DNA, 445 bp, Mycobacterium tuberculosis
agcttcggtgtagccgatcaccggaagccgcatgatcagccacgtttcgcgccgcccggcatacggcggcgtaccgatctccgcgtcatacacccgcgggtaatcgccgacggtgccggttcgcgagccgaaggtgacgacgctgattgaatcgagttccaggtccagcgggtggcgcagcaacggcgcgagctcaacgacgtcaatcacgttgtcgctttctacggtcaccgacccggtgaccgtagtcgcccggtgcgctcggccgagaagttgcaccgccaccaccgcgacaccgtcttgcacgcggacgccacccccggatcggttgttggccaaggtaattgggtcattccatttgacgggacgccgaccccgcagccccagtaccgcccacgaccacgccggctgacccaccactgtacgaacaccaaggcgacgccga

SEQ ID NO: 102 - DNA, 261 bp, Mycobacterium tuberculosis
atactcaagcttcggtggcttcgcccgccctgccgggtggacttcatgacaacgcgggggcgattacccccgctaccgccagcagcatgacggcggtacctaacaccgcccggatgcctcgcacgtgcctcgatgtgctcacggaatcgccccggcaccgcgatctcgaggatcaccagcgttacccccggcagcgcgacaccgacaattccgtacaccgccacgccgatccggccctgggccagctgattggagctggcg

SEQ ID NO: 103 - DNA, 244 bp, Mycobacterium tuberculosis
caggcatgcaagcttccacatgtacggatccacgaacatcccgttgaactgacaggtgcggcccggctcgatcaggccggccacttgttctacgcggttaccgaagatctcttcggtgacctgcccgccgccggccagctcggcccagtgcccggcgttggccgccgcggcgacgatcttggcgtccacggtggtccgggtcttgcccgctagcacgatccgcgagtcggccggtcacccgggt

SEQ ID NO: 104 - DNA, 376 bp, Mycobacterium tuberculosis
atactcaagctttccaagtcccaagtgtcgatcatggccaaagagctcgacaaagccgtagaggcgtttcggacccgcccgctcgatgccggcccgtataccttcctcgccgccgacgccctggtgctcaaggtgcgcgaggcaggccgcgtcgtcggggtgcacaccttgatcgccaccggcgtcaacgccgagggctaccgaaagatcctgggcatccaggtcacctccgccgaagacggggccggctggctggcgttcttccgcgacctggtcgcccgcggcctgtccggggtcgcgctggtcaccagcgacgcccacgccggcctggtggccgcgatcggggccaccctgcccgcagcggcctggcagcgct

SEQ ID NO: 105 - DNA, 284 bp, Mycobacterium tuberculosis
caggcatgcaagcttcacacgtaggcgccgtcgataaatgactccgccgcgcttcgcacatcctcgtagcgatccttggcgagcaggtcaaccgggcgctgcccgtcgaggagccggtttttggcgtgcagccactggccgacacctcggggggtaagcgaatccgagagcaggaggacgaggtcacgaagctgcgccagccggtcgtaccgctcagggcggatgtcgccggtccgccacccgcgtaccgcccgatcggacacctgtatgaccgcggcgacgtc

SEQ ID NO: 106 - DNA, 140 bp, Mycobacterium tuberculosis
cgcggcggcgcattacccccgctaccgtcagcagcttgacggcggtagcgaacaccgccggatgcagcgcaggtgcgtctatgtgcacacggaatcgccccggcaccgcgatctcgaggatcaccagtgcccgccccctg

SEQ ID NO: 107 - DNA, 491 bp, Mycobacterium tuberculosis
  modified_base (459): a, t, c or g
gggatcgaggaacagcgcgttgaactgataggtgcggcccggctcgagcaggccggccatttgttcgatgcggttaccgaagatctcttcggtgacctgcccgccgccggccagctcggcccagtgcccggcgttggccgccgcggcgacgatcttggcgtccacggtggtcggggtcatgcccgcgagcaggatcggcgagcggccggtcagccgggtgaacttcgtcgagagcttgaccctgccgtcggggaggcgaaccacggtcggtgcgtatctcgaccaggcccgggcaacctcgggggtggcgccgacggtgaacaggttgcgctggccaccgcgggtagccgccggcactatgccgatgcccaggccgcggatcaccggtgcggtcagtcgggtcaggatgtcgcccggccccaggtcgaagatccagcgggcgccggccgcgtggacacnggtgatctcgtccaccatcgactttctgatca

SEQ ID NO: 108 - DNA, 364 bp, Mycobacterium tuberculosis
  modified_base (350): a, t, c or g
  modified_base (355): a, t, c or g
taactcaaggcttgcgttgaggccccaggcccatcgacggtttggcggccttaaatgcactgaggtcgtcaattgaccccacagcggaaatgccgactattcgcaggcctccttcgccttggctgccggagaggggctccgcgggaaccgcatgcaggtatatgacctcggtttctcgggtgctaccgcgtgccttgtcgaggatgaactcggcgttggaattgtccagccggcccaattcatcgagcgcagattcgtacacatggccggcggcgacatacgcttcaccgtggatctgctccacacggaccgccctgtcgggatcctgctcacgggtaaaggaacttacntggcnctcggtgcc

SEQ ID NO: 109 - DNA, 453 bp, Mycobacterium tuberculosis
ccttctgcgccacccacaccgtcaacgcccgcgaagtcgacgtcgtccaggccatcggcggcctcacggatggattcggcgcggacgtggtgatcgacgccgtcggccgaccggaaacctaccagcaggccttctacgcccgcgatctcgccggaaccgttgtgctggtgggtgtgccgacgcccgacatgcgcctggacatgccgctggtcgacttcttctctcacggcggtgcgctgaagtcgtcgtggtacggcgattgcctgcccgaaagcgacttccccacgctgatcgaccttgacctgcatggccggctgccgctgcagcggttcgtttccgaacgcatcgggctcgaagacgtcgaggaggcgttccacaagatgcatggcggcaaggtattgcgttcggtggtgatgttgtgatggccgccatcgagcgcgtcatcacccacgg

SEQ ID NO: 110 - DNA, 329 bp, Mycobacterium tuberculosis
atactcaagcttgattttgatcatcatgatgatcatcacccgaagtgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcctggcggtgggatccgactacaatctgctgctgatttcccggttgaaaaaagaaattggggccggattgaacaccggaattatccgtgccatggctggtaccgggggagtggttaccgctgccggcatggtgttcgccgttacca

SEQ ID NO: 111 - DNA, 438 bp, Mycobacterium tuberculosis
  modified_base (5): a, t, c or g
attgnctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccagacgacatcgtggcgagattcgccgggtacgccgatgaggtggtgtgtttggcgacgccggcgttgttcttcgccgtcgggcagggttaccgcaacttcacccagacctccgacgaagaagtggtggcgttttctggatcgtgctc

SEQ ID NO: 112 - DNA, 438 bp, Mycobacterium tuberculosis
  modified_base (367): a, t, c or g
atactcaagcttttcccgtccgtcatcgcccaagcgcgtgaggccgaagcggctggttacgactccctgtttgtgatggaccacttctaccaactgcccatgttggggacgcccgaccagccgatgctggaggcctacacggcccttggtgcgctggccacggcgaccgagcggctgcaactgggcgcgttggtgaccggcaatacctaccgcagcccgaccctgctggcaaagatcatcaccacgctcgacgtggttagcgccggtcgagcgatcctcggcattggagccggttggtttgagctggaacaccgccagctcggcttcgagttcggcactttcagtgaccggttcaaccggctcgaanaggcgctacagatcctcgagccaatggtcaagggtgagcgccaacgtttttcggcgattggtacccaccga

SEQ ID NO: 113 - DNA, 482 bp, Mycobacterium tuberculosis
cggccaccggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacggcgacccggcctatggttattcgacctcgccgcccaatgttgcgactccgttcgggttgttcccagaggtcagcccggtcgtcatcgccgacgctctcgtcgccgggaccagcagggaatcggcgatttcgcctaca

SEQ ID NO: 114 - DNA, 388 bp, Mycobacterium tuberculosis
  modified_base (172): a, t, c or g
  modified_base (350): a, t, c or g
  modified_base (355): a, t, c or g
  modified_base (369): a, t, c or g
atactcaagcttggggtggcgctgtcggtcggtgtgcttggcggcgtcggtatcaacaccgcccacgaaatggggcacaagaaggattcgctggagcggtggctgtccaaaatcaccctcgcccagacctgctacgggcacttctacatcgagcacaaccgtggccatcacntccgggtgtccacaccggaggacccggcgtcggcgcggttcggcgaaacgttgtgggagttcctgccccgcagtgttatcggcggcttgcgctcggccgttcatttggaggcccaacggctgcgtcggctcggcgtcagcccctggaatcccatgacgtatctgcgcaacgacgtgcncaacncgtggctgatgtcngtggtgttgtggggtgggc

SEQ ID NO: 115 - DNA, 455 bp, Mycobacterium tuberculosis
tcgccaccgcaccgcggcgaacgctcaaaggcacctactggcaccaaggccccacacgtcaccctgtgacctcctgcgccgaccccgcccgaggtcctggccgttaccaccgaacgggcgagccgggagtctggtacgcatcgaacaaagagcaaggtgcatgggcggagttgttccgccacttcgtcgatgacggggtcgatccattcgaggtccgtcgccgcgtcggtcgagtggcggtcacactccaggtactcgacctcacagacgagaggactcgatcccatctaggtgtggacgaaacagatcttctgtccgacgactacaccaccacccaggccatcgccgccgcccgcgatgccaacttcgacgccgtactggccccggcggcggcgctccccggttgtcaaacactttgccgtgttcgttcacgcactgcccaacatcgagcccga

SEQ ID NO: 116 - DNA, 328 bp, Mycobacterium tuberculosis
atgaaataagaagagcacatccctcagtcggttatcatcactagcgctcgccgcacccgtgtaaccgatcatagcgagcgaactggcgaggaagcaaagaatatctgttctgtcagatagctcttacgctcagcgcaagaagaaatatcccccgcgggaacaactccaggtagaggtacacacgcggatagccaattcagagtaataaactgtgacactcacaccctcatcaatgatgacgaactacaccccgatatccggtcacatgacgaagggaaagagaaggatatcatctgtgacaaactgccctcaaatttggcttccttaa

SEQ ID NO: 117 - DNA, 318 bp, Mycobacterium tuberculosis
atactcaagcttgtcgaactccttcttgaataccggccggccatccacagatgcccggaagaacttccaggtacccatggcggctggatcagggggcggcacagttggtcttgtcctgcctcgagtggcgtcgttgtccggcttggacggggctccgacggtaccggagggcagcgacaaaacacttatgcacttgggcgacccgccgagacggtgcgacacccatcccgacggcacaagctcagccgcggccgctcttgttcttcgtcggatcgacattcacccacttctgaccgggcttgggcgaaggaagcagaa

SEQ ID NO: 118 - DNA, 405 bp, Mycobacterium tuberculosis
ggtatagtcgctgaccggtgcaggtttcgacaatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtcggctcggatagcgaggtcagcgaattctcgtggcagctcgaaagggtcctgccggtgccggtctttgcgcaaacgatggcgcaggttacggtcgcgcggggtgcggccctggcggcggccca

SEQ ID NO: 119 - DNA, 89 bp, Mycobacterium tuberculosis
  modified_base (11): a, t, c or g
  modified_base (78): a, t, c or g
  modified_base (83): a, t, c or g
gacactatatnatactcaagcttcaggtcaatgtgcgccaagccctgacgctggccgaccaggccaccgccgccgganccctntctaga

SEQ ID NO: 120 - DNA, 354 bp, Mycobacterium tuberculosis
  modified_base (110): a, t, c or g
  modified_base (238): a, t, c or g
  modified_base (242): a, t, c or g
ctgtagccacctgttgccatccccgtcatgcccgactctggtcatctcggatccgctgacaccccgctaaggctgctcctctcggtgcattacctcaccgacggcgaacncccccagctttacgactatccggatgacggcacctggttgccggctaacttcaccgtcagcttggacggcggcgctaccgtcgatggcgccagcggggcgatggccgggcccggcgaccgattcgtcntcancctgtcgcgtgaacttgccgacgtcatcgtggtcggtgtgggcaccgtgcgcattgagggctactccggcgtccggatgggtgtcgtcaagcgcccgcaccggcaggcccga

SEQ ID NO: 121 - DNA, 379 bp, Mycobacterium tuberculosis
  modified_base (170): a, t, c or g
atactcaagcttcgcacgctcggcgcgcgcggtaccgcccaggtcgcccaacagatcgtcgatgttcgcgtcgtccgcctcgcgcacgtggtctgtcaccagtcaacgttaacgccgccgcacatgtcctgcggccgggcaaaaacgtgaaaaacgagcgggcgactgcnatgtcatgacaccgacggccgccgatgggcccagggtctggcaaattcgatctgtgcggccagtgccagcagcgtcgcctcgtcatacggccggccgacgagttgaaccgacatgggcaggccgtcgccgtcgaagtcccacggcaccacgggcgcgggctggccggtcagattccaaaattgaaagtacggaaccgctgcaccaccaa

SEQ ID NO: 122 - DNA, 393 bp, Mycobacterium tuberculosis
  modified_base (370): a, t, c or g
atcgtttcgaccaggcgctccatccggcgagtggatactcccagcaggtagcaggtcgccaccacgctggtcagtgcgcgttcagctcgcttgcggcgctgcagcagccagtccgggaaatagctgccctggcgcagcttggggatcgcgacgtcgatggttgcggcacgggtgtcgaaatcacggtggcggtagccgttgcgctgattggaccgctcatcgctgcgttcgcggtagcccgccccgcacagggcgtcggcttcagcccccatcaaggcggcgatgaacgtcgagagcagcccgcgcagcagatccgggctcgcctgtgcgagttggtcagccagaagctgctcggtgtcgataagatganaagaagtcattgcgttatttcct

SEQ ID NO: 123 - DNA, 333 bp, Mycobacterium tuberculosis
  modified_base (206): a, t, c or g
atactcaagcttgggtgttgccgatcaccggaagccgcatgatcagccacgtttcgcgccgcccggcatacggcggcgtaccgatctccgcgtcatacacccgcgggtaatcgccgacggtgccggttcgcgagccgaaggtgacgacgctgattgaatcgagttccaggtccagcgggtggcgcagcaacggcgcgagctcaacnacgtcaatcacgttgtcgctttctacggtcaccgacccggtgaccgtagtcgcccggtgcgctcggccgagaagttgcaccgccaccaccgcgacaacgtcttgcacgcggacgccaccccccggat

SEQ ID NO: 124 - DNA, 426 bp, Mycobacterium tuberculosis
  modified_base (5): a, t, c or g
  modified_base (424): a, t, c or g
gcgcnaacagctcgcggcagcccacgacgtgctgcgtcggattgccggcggcgagatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccagcgtgatcaggctcggctcgcgagttcggcgaaaaagtggctcgcctgatcacctaccatcggccaggatctgcgtgtcatcacgacgctcgccaaggaggttgttgtggtgctatcgacggcctttagccagatgttcggaatcgactatccgatagtgtccgcgccaatggacttgatcgccggcggtgagctggctgccgcngt

SEQ ID NO: 125 - DNA, 336 bp, Mycobacterium tuberculosis
atactcaagctttctccgatacccgccatgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggaaacaaaagtatcgctaaggtcaccgcgatcacgaacatggtgatcgcagcaatgttgctagtgatctatcgctccg

SEQ ID NO: 126 - DNA, 347 bp, Mycobacterium tuberculosis
ccatgagcaccgccagccgagcacgaggccaaactccgccgacgcaggccggttggacttgtcgtgctggacaaggggtttagccgccgaagcagtgacgtacatcggcgaagagcagttcgcctgtcgaccgacggcgcaaaccgtgaggctagggaagcgaggagcacatggccgccgacccgcaatgtacacgctgcaagcaaaccatcgaacccggatggctatacatcaccgcccatcgccgcggtcaagccgggatcgtcgatgacggcgcagtactgattcacgtgcccggtgaatgccgcaccccggggagcactttccgccaaaactaacccggttgg

SEQ ID NO: 127 - DNA, 315 bp, Mycobacterium tuberculosis
  modified_base (129): a, t, c or g
  modified_base (153): a, t, c or g
  modified_base (186): a, t, c or g
  modified_base (231): a, t, c or g
  modified_base (258): a, t, c or g
  modified_base (298): a, t, c or g
cgggtgtcattggccaccggcggcggctgtccgggaaatggcgggtccccggtggttttgctgaggagtgctgaaccgtagtcgaagtgggcggcgtcagactccacccagccagcaggcagcgcgaanctgaatcctccaaccgggttgtcnatccggacaggttggggtgcgtttggggcaatnacaggtggcggcggtgcgttcgggtcggccggcggaggtgctgcnttgggatccccggctgggcattcggcntgttggcggcggccggtggtggggggggcaacacgtgtcnccggtgcgggtggccct

SEQ ID NO: 128 - DNA, 354 bp, Mycobacterium tuberculosis
  modified_base (135): a, t, c or g
  modified_base (253): a, t, c or g
ccaagatctacaccatcgaatacgacggcgtcgccgactttccgcggtacccgctcaactttgtgtcgaccctcaacgccattgccggcacctactacgtgcactccaactacttcatcctgacgccggaacaanttgacgcagcggttccgctgaccaatacggtcggtcccacgatgacccagtactacatcattcgcacggagaacctgccgctgctagagccactgcgatcggtgccgatcgtgggganacccactggcgaacctgggttcaaccaaacttgaaggtgattgttaacctgggctacggcgacccggcctatggttattcgacctcgccgcccaaatgttg

SEQ ID NO: 129 - DNA, 360 bp, Mycobacterium tuberculosis
  modified_base (55): a, t, c or g
  modified_base (224): a, t, c or g
agcttcccgagttcggctttggatcaagaccccagtccgcgggcgcgatccggcngctcggtgactacatcaagccacaaatcgacggctttcggggtgccgataccgatgacgtggcggatgtcgagtgttgagttctcggcggggcggatgctcacctggcgatcacctgcctctcgttgacgatcgatcgtctatgccgccgtctctgcgggaacaggccnccagtacatcgccacagacgggatccacccgcatttcggctacggttgctcgtttcggtgttcggactagtcggtcctggtgacgtgccggtgatgcggaccggtcctagcactgaccaatggccaaaatgcgggc

SEQ ID NO: 130 - DNA, 483 bp, Mycobacterium tuberculosis
cggggggcctcttaatagtgtaggaaagaagctctacatattcaggaggattcaccatggctcgtgcggtcgggatcgacctcgggaccaccaactccgtcgtctcggttctggaaggtggcgacccggtcgtcgtcgccaactccgagggctccaggaccaccccgtcaattgtcgcgttcgcccgcaacggtgaggtgctggtctgccagcccgccaagaaccaggcagtgaccaacgtcgatcgcaccgtgcgctcggtcaagcgacacatgggcagcgactggtccatagagattgacggcaagaaatacaccgcgccggagatcagcgcccgcattctgatgaagctgaagcgcgacgccgaggcctacctcggtgaggacattaccgacgcggttatcacgacgcccgcctacttcaatgacgcccagcgtcaggccaccaaggacccggccagatcgccggtctcacgtgctgcgg

SEQ ID NO: 131 - DNA, 423 bp, Mycobacterium tuberculosis
atactcaagcttcataacaggcctgttgtgggcgcacccggctcgccgagttctgcacgcaccgcctcaagtgcggcccgcaccgccggcatctcccggtcacgcagggccgcggcccgcgccgcagcgacggcgtgttcgcgcagttcgccgtcaatgatgctgacctgatcggccacccgggcgttctcggcgtcttcgcgttcactaatcgcggtgctcagcagcgtctcgacagccaccacccgagtggcgaccagctgctccaccacggaccgcagcgatgccgtcacctcacccgtccagcggtccaccacgacacggtcgtgcaccagcgcgcgggcattcaccacccaggcggtcaccgccaggccgatcgccacacccgccaccatccccgatgcagccaggccgggagtaaga

SEQ ID NO: 132 - DNA, 338 bp, Mycobacterium tuberculosis
  modified_base (255): a, t, c or g
  modified_base (289): a, t, c or g
ctggtgctggacggagcctagtacaacttcctctccaatgctcttgccccgatcgcggcgaccaggatgacccaggacatcctgccgcccgaagtactggaaaagctcacacccgagttcgtcgcaccggtggtggcctacctgtgcaccgaggagtgtgccgacaacccatcggtgtacgtcgtcagtggtggttaggtgcagcgagttgcgctgtttggcaacgacggcgccaacttcgacaaaccgccgtcngtacaagatgttgcggcgcggtgggccgagatcnccgatctgtccggtgcgaaaattgctggattcaagttgtagaactaaat

SEQ ID NO: 133 - DNA, 173 bp, Mycobacterium tuberculosis
atactcaagcttttccggcgtcgtccacctgacccaaaaagcgcaggtgcgccgccaaacggcccgcctggccgcgcaactggtcggcgtcgccgtggccgacaatcagtagctggacatccggaaaccgctgcaccaccttcggcagcgcgtcaagcaaaaacggccattcc

SEQ ID NO: 134 - DNA, 255 bp, Mycobacterium tuberculosis
tttcagatctcatttttatgacatgactggagatctgtctagattgcagctcctgtgagcgtgggtaccggattcaagccggtcggtcacgccgcggtggtaccggctttgcggcagtgctcggcctcgagttcggcgatcgcgcgcgaagtgcgtttcgcgcaccaagatcgcggcctaatggccggcgatgaccgcgatgaccagcgcgatccaggaaaaaccgttccaaccagtgctgggcggccatccccg

SEQ ID NO: 135 - DNA, 285 bp, Mycobacterium tuberculosis
atactcaagcttcccgaccacaagttgaacagcaccgatttcggcgagcacttcgtcaacttccagggtgcccgcaccaagtatttcgacaagtatttccgtcgggccgccgccgccggcgcgcggcaggtggtcatcctggcggcggggctggactcccgcgcgtaccggctgccttggcccgacgggaccacggtttttgagctggaccgcccgcaggtccttgatttcaagcgcgaggtgctcgccagccacggtgcccaaccgcgcgccctgcgcccgcga

SEQ ID NO: 136 - DNA, 494 bp, Mycobacterium tuberculosis
gtgtgctgtcaattcagagctgagcctgatgcactcaacttactgagcatgctaacgctggtcgtgcgggtcttgttcccgcgtgtcggcagggcacacgctcggggcgtagctgggagaggccccggtcaagcccggagagcagtgctcagtccgccagcttgaccgactttcgatgagaacgcgcttctcgccgtattgaactggcgtgctgacggtcgctgagcagcgctcgccgagtgcggccgctgattctttcatcgagccaggaggcgcattcgtgttcggccgcctgcgggtcggccccatcgtcgacgcgatccgtcacccactcctcgatcaggtctgcctcatcgaacgggccaacggtgctgtcggagtatgtgtgcgtgggcacggcgagccgggtgctgtggtacacccaccgttgcatgaccaagttgacgcctgactggctgagcaccgcgatccgctcacaggtcggaacgttggtg

SEQ ID NO: 137 - DNA, 357 bp, Mycobacterium tuberculosis
atactcaagcttttggtctagccggccgagcccgatacaggtgtcattggccaccggcggcggctgtccgggaaatggcgggtccccggtggttttgctgaggagtgctgaaccgtatgcgaagtgggcggcgtcagactccacccagccagcaggcagcgcgaaactgaatcctccaaccgggttgtcgatccggacaggttggggtgcgtttggggcaatgacaggtggcggcggtgcgtccgggtcggccggcggaagtgctgcgttgggatcgcccggctgggcattctgcgtgttggcggcggccggtggtgggggggcaacaggtgtctccggtgcgggtggcgctgcacc

SEQ ID NO: 138 - DNA, 458 bp, Mycobacterium tuberculosis
ggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacggcgacccggcctatggttattcgacctcgccgcccaatgttgcgactccgttcgggttgttcccagaggtcagcccggtcgtcatcgccgacgctctcgtcgccgggacccagcacggaat

SEQ ID NO: 139 - DNA, 595 bp, Mycobacterium tuberculosis
  modified_base (5): a, t, c or g
  modified_base (13)..(14): a, t, c or g
  modified_base (21)..(23): a, t, c or g
  modified_base (28): a, t, c or g
  modified_base (36): a, t, c or g
  modified_base (42): a, t, c or g
  modified_base (57): a, t, c or g
  modified_base (72): a, t, c or g
  modified_base (76): a, t, c or g
  modified_base (218): a, t, c or g
  modified_base (301): a, t, c or g
  modified_base (328): a, t, c or g
  modified_base (337): a, t, c or g
  modified_base (405): a, t, c or g
  modified_base (408): a, t, c or g
  modified_base (413): a, t, c or g
  modified_base (468): a, t, c or g
  modified_base (483): a, t, c or g
  modified_base (491): a, t, c or g
  modified_base (493): a, t, c or g
  modified_base (498): a, t, c or g
  modified_base (525): a, t, c or g
  modified_base (533): a, t, c or g
  modified_base (539): a, t, c or g
  modified_base (546): a, t, c or g
  modified_base (573): a, t, c or g
  modified_base (577): a, t, c or g
  modified_base (580): a, t, c or g
  modified_base (589): a, t, c or g
ttctntcttcccnnattcgtnnntctcntactaccngggccncaaaacaccttggcnaacgctcaaaggcgntacnggcaccaaggccccacacgtcaccctgtgacctcctgcgccgaccccgcccgaggtcctggccgttaccactgaacgggcgagccgggagtctggtacgcatcgaacaaagagcaaggtgcatgggcggagttgttccgccnctttttttatgacggggtcgatccattcgaggtccgtcgccgcgtcggtcgagtggcggtcacactccaggtactcgacctcncagacgagaggactcgatcccatctangtgtggacnaaacagatcttctgtccgacgactacacaccacccaggccatcgccgccgcccgcgatgccaacttcnacnccgtnctggccccggcggcggcgctccccggttgtcaaacacctgccgtgttcgttcacncactgcccaacatcnagcccgancnatccnaggtccgtccaacgcctccgcggctcnccaacctnctcccnctgatcntccgcaccaaacacatgcccgactccntgcnccnattgcttgnatccct

SEQ ID NO: 140 - DNA, 434 bp, Mycobacterium tuberculosis
ccgctatcggtcggtgtgcttggcggcgtcggtatcaacaccgcccacgaaatggggcacaagaaggattcgctggagcggtggctgtccaagatcaccctcgcccagacctgctacgggcacttctacatcgagcacaaccgtggccatcacgtccgggtgtccacaccggaggacccggcgtcggcgcggttcggcgagacgttgtgggagttcctgccccgcagtgttatcggcggcttgcgctcggccgttcatttggaggcccaacggctgcgtcggctcggcgtcagcccctggaatcccatgacgtatctgcgcaacgacgtgctcaacgcgtggctgatgtcggtggtgttgtggggtgggctgatcgcggtcttcggcccggcgctgatcccgttcgtcatcatccaggcagtcttcggcttcag

SEQ ID NO: 141 - DNA, 321 bp, Mycobacterium tuberculosis
  modified_base (42): a, t, c or g
atactcatgcttgccgaagttccgatgggtcgcgccggcgancccagcgaagtcgctagcgtggccgtgttcttggcttcggatctatcctcgtacatgaccggcaccgtgttggacgtgactggcggccggttcatatgacaccgagatcattgccacggtacggcaattcgtcaagaaggaaatctttcccaatgcaccggccctcgaacgtggcaacagctacccgcaagaaatcgtcgatcggctgggtgttattggcttgctcggtcgccggctgcaagggtatcgacaccaccgagttcattctccgggcgtgcc

SEQ ID NO: 142 - DNA, 348 bp, Mycobacterium tuberculosis
ggcgtcaacggtgtcggcaccggcgtcctgcagttggtaggcctgcagtttgtgcatcaggccgatgccgcggccctcgtggccacgcatgtacagcaccacgccgcgcccctcacgggcgaccatcgccagcgcggcgtccagctgaggcccgcaatcgcagcggcgtgacccaaacacatcgccggtcaagcactccgaatgcacccggaccagcacgtcgtcaccgtcggcgttgggcccggcgatctcgccgcggaccagcgcgacatgttccacgtcctcgtagatgctggtgtagccgatggcgcgaatctcccatgacgagtcggaatccgcgcctcggcg

SEQ ID NO: 143 - DNA, 339 bp, Mycobacterium tuberculosis
atactcaagcttcggcctcgctgcaggagtgggagccgcagggctggaaatccgaaaaacgagccggtgatcgcactgtcgccgatcggggccgcacctggttggtgttaccgatgaatccgcacccaaaatgtggctgcggtggcgtttcttgactccttggcgtcgactcttgtggcagccaccgagcggttggtccaggatctggatgggcaaagttgtgcggcccggccggtgacggccgatgagctgaccgaggtcgacagcgccgtgttggctgacttggaaccgacatggattcgccccggttggcgtcacctcaagcatttcaatggttat

SEQ ID NO: 144 - DNA, 269 bp, Mycobacterium tuberculosis
  modified_base (264): a, t, c or g
atgcgtcaccccgatgcgcccagatcggggcttcgcaaataaagcacgaacaggcgggcaaaacgtctatctcggagccggaagggcaatcagccgaccgtcgacgaacgacaccggcgataaccacttaggcgttgaacggccggcccaaacattacgcctccgttgataaggctttcggtctcttccccggtcatcccaagcaccttgcggcaaatttgaacgctttcctgtccgggcaccggccccgggctttggggtccntccga

SEQ ID NO: 145 - DNA, 285 bp, Mycobacterium tuberculosis
  modified_base (187): a, t, c or g
atactcaagcttcaatcgcgccgccacaatccaaatatgcgtctagcgtctcgatgagcgtcggtccggcatcggctaggggccgcatcacgtcggtatgcagggccacgatcgcccaaggcgtcgcccatcaagggcgcgttcgggcaaaaattcccctatccagcacgggccgcggcgctccgcnccagccggcgacggcgttcatcccggagatcgcctcgctagcgctgcggtgcgccgcggtcagcatgggcgccgtggggccgatgaccaccggggcgt

SEQ ID NO: 146 - DNA, 75 bp, Mycobacterium tuberculosis
ttcggcgggtctgtagattgcggtcggccaccccacaggcactcatgaaccgcagcccacgatcgatctcggtgg

SEQ ID NO: 147 - DNA, 164 bp, Mycobacterium tuberculosis
gcgcaccatcgccagtaggtgcccgtggtcgggcgcgtcgagccacccgagcggaaacgcgagtccgaacagcaacagcaggacgggcgcaaccagggcggtgaccatgcccccggcgctgaacatcaaccacaggaagggctccgccgagcgtccgcgcgacc

SEQ ID NO: 148 - DNA, 228 bp, Mycobacterium tuberculosis
  modified_base (26): a, t, c or g
  modified_base (30): a, t, c or g
catcgtcgaacttcggtccgggttgntagnaccgcagcaccaaacgcacccaccgacccccacgcttcacgccaaccctttagttcattggcgtgaacagcagcgtagccggttgccccgatatatgtggaaaaatcgttcggacgtacaaaaaaagttcctgacgctggcgtcaactcgaaactgcctcggaagtcaatgatgatccatcagtcaatattaaagtcg

SEQ ID NO: 149 - DNA, 238 bp, Mycobacterium tuberculosis
  modified_base (230): a, t, c or g
atactcaagcttgtctgctgcctcagcgtatgcatccaacagcgcatcgcgatcaacgatcaggcgcgccgatttcgggccgcgggcagtggcactggccagatggccgtttttttcgagaaacttcaacgcctgagcgctgcttcccatcgagagaccggtggcctctacaaccgatgcgacagttggaccggcgatgttcgccagcagcgcttcacatacggcaagtntggcgcgg

SEQ ID NO: 150 - DNA, 162 bp, Mycobacterium tuberculosis
ttgtccaggcggggaatcgggcagggagacgacaccttcgttcggttcgatcgtcgcgaacgggtagttggccgcgaccacgttgtttcgggtcagcgcgttgaaaagtgtcgacttgccgacgttgggcaggcccacgatccccaggctcaagctcacaga

SEQ ID NO: 151 - DNA, 377 bp, Mycobacterium tuberculosis
  modified_base (185): a, t, c or g
  modified_base (190): a, t, c or g
  modified_base (192): a, t, c or g
  modified_base (314): a, t, c or g
atactcatgcttggcgcctgggtggcagcccacctgcccaccacacggaccgcggtgcggacgcggctgacgcgcctggtggtcagcatcgtggccggtctgctgttgtatgccaacttcccgccgcgcaactgctggtgggcggcggtggttgcgctcgcattgctggcctgggtgctgacccnccgcncnacaacaccggtgggtgggctgggctacggcctgctattcggcctggtgttctacgtctcgttgttgccgtggatcggcgagctggtgggccccgggccctggttggcactggcgacgacgtncgcgctgttccccggcatcttcggtctgttcgccgtcgtggtaccctgttgccgggttggccc

SEQ ID NO: 152 - DNA, 308 bp, Mycobacterium tuberculosis
  modified_base (264): a, t, c or g
  modified_base (280): a, t, c or g
cgccaattcacgatatcgttaaccgatatcccgagccgatagctggcgggctcgggtggtggccagcggcgctgcgacgaaaggtgtgaccgtcatgaaacagacaccaccggcggccgtcggccgtcgtcacctgctcgagatctcagcatccgcagccggtgtgatcgcgctttcggcgtgtagtgggtcgccgcccgaccccggcaaaggccggcccgacacaaccccggaacaggaagtcccggtcaccgcgcccgaagnacttgatgcgcgaacncggagtgctccaaacgcatcctgctgat

SEQ ID NO: 153 - DNA, 377 bp, Mycobacterium tuberculosis
atactcaagcttgggcactgacttcggtaccccctccgcctttggccagcagcagccacagcgcggttcgcggaccgaacgtggacatcaatagcccggaatcggtgtgtgcaagttggtaaacggtgttgatcccaagctttgccagccttttcgtagtcttgggccccacaccccacagtgcttcgacggtacggtcacccatgatggccatccagttggcatcggtgagctgataaatgccagctggtttcgccaacccggtagcgatcttggcgcgctgcttgttgtcactgatacctatcgagcaagacagcccggtttgcgacaaaatgacttttcggatctcttcggcgacttcgatggggtcgtcggga

SEQ ID NO: 154 - DNA, 259 bp, Mycobacterium tuberculosis
aaagtcctgtgccggttcgctaaacacccggcggacactcagacggtgctggtggtgcggcatggcaccgcgggcagcaaagcgcacttctccgggggacgacagcaagcgaccgctagacaagaggggtcgtgcgcaggcagaaacgttggtacacagctgctggcgttcggcgccaccgatgtttatgccgccgaccgggtgcgctgccaccagacgatggagccactcgccgcggaactgaacgtgaccatacaca

SEQ ID NO: 155 - DNA, 372 bp, Mycobacterium tuberculosis
  modified_base (339): a, t, c or g
  modified_base (366): a, t, c or g
atactcaagcttgggttccacgcccgcgcagccacgccgtcacctttccacgagacctcacctgccgatccgaaatggaatcggccgtgacggaattggcgcaccgaacacccaacgaggtggtggcttcgtcgcgaaccgtcacccgagtcgcggccaccgtgcgcacggcgacgttctacacccgcaccaagatccgaaagctgcaagctcccagcaccgatcccgacgtcatcaccgctgccgcccggcacgtccttgacctattcgagctggatcggcccgtccggttgctgggagtgcggttagaactggcctagaaccggcgggcacaccgcncctgggcggggcgaattcttgaccgcnccggcc

SEQ ID NO: 156 - DNA, 290 bp, Mycobacterium tuberculosis
cgcggttggcgtagttggacgggtcgccctccgaggccaatgatgacgatgaccacgccgatcacgatggccaccgagagggacaacaacagaaagctgacgaatccctccttggcggccggggctttgtggtcgccggtcgcgatgggcgcgaatttacggcccgctcccccaggccgccgcgaagcagggtccccagccagttggcgtaggcggaattaacgatcagcgccaccgcgataacctgccatgcctcgggcatatcgatgtgcggccagaacaggccgaac

SEQ ID NO: 157 - DNA, 470 bp, Mycobacterium tuberculosis
  modified_base (331): a, t, c or g
  modified_base (362): a, t, c or g
ccaacaagagcatcgggacatacggagtcaactacccggccaacggtgatttcttggccgccgctgacggcgcgaacgacgccagcgaccacattcagcagatggccagcgcgtgccgggccacgaggttggtgctcggcggctactcccagggtgcggccgtgatcgacatcgtcaccgccgcaccactgcccggcctcgggttcacgcagccgttgccgcccgcagcggacgatcacatcgccgcgatcgccctgttcgggaatccctcgggccgcgctggcgggctgatgagcgccctgacccctcaattcgggtccaagaccatcancctctgcaacaacggcgacccgatttgttcngacggcaaccggtggcgagcgcacctaggctacgtgcccgggatgaccaaccaggcggcgcgtttcgtcgcgagcaggatctaaccgcgagccgcccatagattcccg

SEQ ID NO: 158 - DNA, 434 bp, Mycobacterium tuberculosis
  modified_base (4): a, t, c or g
  modified_base (134): a, t, c or g
  modified_base (178): a, t, c or g
  modified_base (355): a, t, c or g
taanacccgtgtaatttgggatgggcaaaaaggccaagcaccgcgtggccacgaacgccgggagggacaatctcgggcggctagggcttctcgcgggaaggcccgaacgtacggcgtttcaacacgtcgcgtcnccctccgaccgcgaacattcggggatggcagcaacctggtagcnccctggccgggcgatgatctgcagcgtcgccgcgggtagtcgccgcccgggcggctacagtctgaaacgcgatgaccatcgatgtgtggatgcagcatccgacgcaacggttcctacacggcgatatgttcgcctcgctgcgccggtggaccggtgggtctatcccggagaccgacntcccgatcgaagcgaccgtctcctcgatggacgccggcggcgtcaccctgggtttgctcaccgcctggcgtggccccaa

SEQ ID NO: 159 - DNA, 363 bp, Mycobacterium tuberculosis
  modified_base (363): a, t, c or g
gtccgcaaaagactcagcggccgactttgctcgcagctggcggtaccgcgccaccgattcgatgccgtggtcgcggaagaatgcctcccgaaatcgcacggccgactccagttcggcgagcatccgcgatgccagctgcggctgcgccctgccggccacggcacccacatgcggcagttcgtccacctgggccagcgccccgccgccgaagtccaaacaatagaactgcacccggcccgcatcgtgggtagcagccaacgccatgatcagcgtccgcagcgcggttgacttgcccgtttgcggtgcacctacgaccgcgacattgcctgcggccccggacaagtcgatcgtcagcggcacccn

SEQ ID NO: 160 - DNA, 301 bp, Mycobacterium tuberculosis
  modified_base (27): a, t, c or g
  modified_base (267): a, t, c or g
cgtggccacgaacgccgggagggacantctcgggcggctagggcttctcgcgggaaggcccgaacgtacggcgtttcaacacgtcgcgtcgccctccgaccgcgaacattcggggatggcagcaacctggcagctacctggccgggcgatgatctgcagcgtcgccgcgggtagtcgccgcccgggcggctacagtctgaaacgcgatgaccatcgatgtgtggatgcatcatccgacgcaacggttcctacacggcgatatgttcncctcgctgcgccggtggaccggtgggtctatccc

SEQ ID NO: 161 - DNA, 436 bp, Mycobacterium tuberculosis
  modified_base (334): a, t, c or g
atactcaagctttgcggcgggcgccgaaatgtgaacgcaccaaacccgcccgctgcgggtcggcgggccactcgacctcgaatttcgccgccgtgaccatccagcccgacggcagttgggcacccggccccccggtcgcggcataactgttggcgtcgccgtcataaagctcgaacagcaccgaaaccgactccaccaccggccggtgcgcctcaaaatccacgccgatctccacataccgggaaaacgtcggtgtcccatcgggtttcggcttgcccgccagctgcacaccaccggtggcctcggccaccttcgcggcctgagcgcagctacncatcctgacgatcatcaccccgcccccggctcacgcttggcctccgtgaccgcacgcatcgcccggttgcgcgcaccgcgacgcccgtacagccgcgcgcac

SEQ ID NO: 162 - DNA, 390 bp, Mycobacterium tuberculosis
  modified_base (333): a, t, c or g
  modified_base (363): a, t, c or g
agcttgccgggactgcggaacagaagcggcggttcctaccgcggtgtgcggccggcgcgatatcggcctttttactaaccgaacccgatgtgggctccgatccggcgcgcatggcatcgacggcgacgccgatcgatgacggccaggcttacgagcttgagggtgtgaagttgtggaccaccaacggtgtggtagcggacctgctagtggttatggcgcgggtaccgcgcagtgaagggcaccgagggggaatcagcgcctttgtcgtcgaggctgattcgcccgggatcaccgtggagcggcgcaacaagttcatgggactgcgtggcatcnaaaacggcgtgacccggcttcatcgcgtcngggtgcccaaagacaacttgatcggca

SEQ ID NO: 163 - DNA, 75 bp, Mycobacterium tuberculosis
ctcaagcttggcgatgcgggctggccaaaactggccgggcgggggttggcttgttcaatcaagggtgggttgccg

SEQ ID NO: 164 - DNA, 110 bp, Mycobacterium tuberculosis
ccgaaggcccgttcccgggcgttcagcaagcgatcgtcggttggcccactgcgggtcgaatcttgcggccgcgccggtcgtggaacgcccaggtcacccggcggcgtacc

SEQ ID NO: 165 - DNA, 455 bp, Mycobacterium tuberculosis
atactcaagcttttttctgctcatgaaggttagatgcctgctgcttaagtaattcctctttatctgtaaaggctttttgaagtgcatcacctgaccgggcaaatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgacca

SEQ ID NO: 166 - DNA, 309 bp, Mycobacterium tuberculosis
ctcaagcttggtgccgacatggccgggctggagcccgcgtatggcaaggttccgctcaatgtggttgtgatgcagcaggactacgttcgcctcaatcagctcaaacgtcacccccgtggcgtgctgcgcagcatgaaggtcggcgcccgcacgatgtgggcgaaggcaacaggtaaaaacctggtcggcatgggtcgagccctcattgggccgttgcggatcgggttgcaccgcgccggagtgccggtcgaactcaacaccgccttcaccgatcttttcgtcaaaaatggcgtcgtgtccggggtatac

SEQ ID NO: 167 - DNA, 232 bp, Mycobacterium tuberculosis
ccgaagcgtgggaaatcctgaccgaataccgcgacgtgctggacactttggccggcgagctgctggaaaaggagaccctgcaccgacccgagctggaaagcatcttcgctgacgtctaaaagcggccgcggctcaccatgttcgacgacttcggtggccggatcccgtcggacaaaccgcccatcaagacacccgggggagatcgcgatcgaaacgcggcgaaacttgggcc

SEQ ID NO: 168 - DNA, 455 bp, Mycobacterium tuberculosis
  modified_base (426): a, t, c or g
cgactcgacaagcattcttgacagttgttttggctcggcatggttagccaaggttctgcggtcccaccagatcatcttggtccggtagcgctcgtccgggtatgctgccgccgggattctcgctgctattactccccccgaaaaacgccaccggtccagcgcgtgggccgccgcggtccccatcacaaactgaacccccaacaggggacatgcttagcggtagggcgcgcgccaaggcggcagcaatcgcatcactgcgctgcgcgtcactattaacccacccggacttcacttccacgaccccgaatggcgcccggtcattgatcatcttgcgcaccgcggataatccgggattgccagcccattcgactaccgcatgcgagtcatcggctgaccgcagcggtccgattacccgagcgccccgantacatctcctccaatatcaatgggcgcaa

SEQ ID NO: 169 - DNA, 428 bp, Mycobacterium tuberculosis
  modified_base (6): a, t, c or g
gcggtntagcttcccgtcgtaccggcgaccgccagccgagaagctcgttttcccagtgttgctggggattctcacgctgctgctgagtgcgtgccagaccgcttccgcttcgggttacaacgagccgcggggctacgatcgtgcgacgctgaagttggtgttctccatggacttggggatgtgcctgaaccggttcacctacgactccaagctggcgccgtctcgtccgcaggtcgttgcttgcgatagccgggaggcccggatccgcaatgacggattccatgccaacgctccgagttgcatgcggatcgactacgaattgatcacccagaaccatcgggcgtattactgcctgaagtacctggtgcgggtcggatactgctatccggcggtgacgacccccggcaagccgccatccgtgctgctgt

SEQ ID NO: 170 - DNA, 385 bp, Mycobacterium tuberculosis
ctcaagcttgggcgtgacggccaccggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctaaagccactgcgatcggtgccgatcgtggggaacccactggcgaacctggttcaaccaaacttgaaggtgattgttaacctgggctacggcgacccggcctatggttattcc

SEQ ID NO: 171 - DNA, 318 bp, Mycobacterium tuberculosis
  modified_base (292): a, t, c or g
cgggtgtcattggccaccggcggcggctgtccgggaaatggcgggtccccggtggttttgctgaggagtgctgaaccgtagtcgaagtgggcggcgtcagactccacccagccagcaggcagcgcgaagctgaatcctccaaccgggttgtcgatccggacaggttggggtgcgtttggggcaatgacaggtggcggcggtgcgttcgggtcggccggcggaggtgctgcgttgggatcgcccggctgggcattcggcgtgttggcggcggccggtggtgggggggcaacangtgtcgccggtgcgggtggcgctgca

SEQ ID NO: 172 - DNA, 443 bp, Mycobacterium tuberculosis
  modified_base (1): a, t, c or g
  modified_base (437): a, t, c or g
ncttgatattggcgtcaacggtgtcggcaccggcgtcctgcagttggtaggcctgcagtttgtgcatcaggccgatgccgcggccctcgtggccacgcatgtacagcaccacgccgcgcccctcacgggcgaccatcgccagcgcggcgtccagctgaggcccgcaatcgcagcggcgtgacccaaacacatcgccggtcaagcactccgaatgcacccggaccagcacgtcgtcaccgtcggcgttgggcccggcgatctcgccgcggaccagcgcgacatgttccacgtcctcgtagatgctggtgtagccgatggcgcgaaactccccatgacgagtcggaatccgcgcctcggcgacccgctcaatgtgcttctcgtgcttgcgccgccattcgatcaagtcagcaatggtgatcagcgccagaccgtgctcntcggcg

SEQ ID NO: 173 - DNA, 420 bp, Mycobacterium tuberculosis
cataagggccggcgtacccggtaccggccgcgggcctaccacgtgccggaactggaagcgcagtaagccctcaacgcgccaccgctttggcccgcgcgcccggcgtaggcgcatcggcggtggccgtggggcggcgcactgcgacctcaccagcggctttcgagctttgttcgatcaaccggccagcatggtcgaggatgcattcgagaccatattcgaaattggtttcatcgggggccccgatccgatgccccctcccagttgcgtgagcaagcagcggagtcgtcgcgggatcgatggccacggggtgttcaatggcggatggtccgctgcccgccgactggctcttgcgggagagccgatctagcaccaccgatccgcgcacgtggaccgaaaccgccgagtagatgtcgaaagcgt

SEQ ID NO: 174 - DNA, 336 bp, Mycobacterium tuberculosis
  modified_base (113): a, t, c or g
  modified_base (141)..(142): a, t, c or g
  modified_base (154): a, t, c or g
cgtccttttccccaagatagaaaggcaggagagtgtcttctgcatgaatatgaagatctggtacccatccgtgatacattgaggctgttccctgggggtcgttaccttccacnagcaaaacacgtagccccttcagagccnnatcctgagcaanatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcg

SEQ ID NO: 175 - DNA, 264 bp, Mycobacterium tuberculosis
ctcaagcttcatgtccgtacggctcgggtacgcttccgtcgcagtgtgcgagtgataaatgacgaccgggacctcgtcggcatcttccatagcccgccacaccttcagttgctcaccggaatccaaccggtagaaggtcggcgagcgctcggcattggtcatcgggatatgccgctcgggacggtcagagccctcgggtccggccagcactccgcaggcttcgtcggggtggtcgcgacacgcatgggccaccatcgcattcac

SEQ ID NO: 176 - DNA, 325 bp, Mycobacterium tuberculosis
  modified_base (1): a, t, c or g
  modified_base (230): a, t, c or g
ncgccgccagccaccacgcgcgggtcgggcgccgggcccgggccgccaggctgctccgctcggtgatggcacgccaccgcgacaccacccggctgcgctacgtcgagccataccgggcggagctacatcggctcggccgcccagtgttcgggccctctttcgaggtcgaggtcgataccgatttgcgcatccgcagccgcaccctggacgacagaaccgtgccctacgantgcttgtcgggcggggccaaagaacagcttggcatcctggcgcgattggccggcgcggcgctggtctccaaagaagacgcccttccggtgctgat

SEQ ID NO: 177 - DNA, 243 bp, Mycobacterium tuberculosis
  modified_base (224): a, t, c or g
cgccacgttcatgggcaacaaccccgatcaccggtggaaatacgtcttcagcacgtcgcaatcgcgtaccaaacacatcacgcatatgattaattcgtccaattgtataaccaacacgttgctcaacccgtcctcgaatttccatatccgggtgcggtagtcgccctgctttctcggcatctctgatagcctgagaagaaaccccaactaaatccgctgcttcncctattctccagcgccggg

SEQ ID NO: 178 - DNA, 430 bp, Mycobacterium tuberculosis
atactcaagcttcaaccgattgacgcattgtgcgaactgacggcgcccgcgcatggccaatccggaagaccatcattggccagtggccgggcgctaacaggttccagccccccaccagtgccgctcgaacatgcggtgcaacccattcgcaggccggcagggaaagcaccgcggaagccgcaaagggctgcagttccgcgcccaatagtgtcgtccgcaaccagatgcgctcgaaaaccgcgccggcagtcagcgcacccgacgcgaggtcgagagacgtcgtcagcgcgcccacatggggtgccaatcggcacggcaggtaggccgcgcgcaacccgaacgcgtggtgcatgcccacggtccgcaggaggcgcagcacccgccaatgccgaagcccacgaaacatcgggcgcatccacgcttcaacctc

SEQ ID NO: 179 - DNA, 448 bp, Mycobacterium tuberculosis
agcttttggcagggtctccttcgaattcggcgtgcaccgctatgggttgcagcagcggctggcgccgcacaccccactggcccgggtgttttcgccccgaacccggatcatggtgagcgaaaaggagattcgcctgttcgatgctgggattcgccaccgcgaggccatcgaccgattactcgccaccggggtgcgagaggtgccgcagtcccgctccgtcgacgtctccgacgatccatccggcttccgccgtcgggtggcggtagccgtcgatgaaatcgctgccggccgctaccacaaggtgattctgtcccgttgtgtcgaagtgcctttcgcgatcgactttccgttgacctaccggctggggcgtcggcacaacaccccggtgaggtcgtttttgttgcagttgggcggaatccgtgctctgggttacagcccgaatcgtcac

SEQ ID NO: 180 - DNA, 380 bp, Mycobacterium tuberculosis
atactcaagctttgtcacaccaactgtttccaccaggcgctccatccggcgagtggatactcccagcaggtagcaggtcgccaccacgctggtcagtgcgcgttcagctcgcttgcggcgctgcagcagccagtccgggaaatagctgccctggcgcagcttggggatcgcgacttctatggttgcggcacgggtgtcgaaatcacggtggcggtagccgttgcgctgattggaccgctcatcgctgcgttcgcggtagcccgccccgcacagggcgtcggcttcagcccccatcaaggcggcgatgaacgtcgagagcagcccgcgcagcagatccgggctcgcctgtgcgagttggtcagccagaacctgctcggtgt

SEQ ID NO: 181 - DNA, 532 bp, Mycobacterium tuberculosis
ccttaagccccgcagggcccggcacgcgcggtaccgcccaggtcgcccaacagatcgtcgatgttcgcgtcgtccgcctcgcgcacgtggtctgtcaccagtcaacgttaacgccgccgcacatgtcctgcggccgggcaaaaacgtgaaaaacgagcgggcgactgcaatgtcatgacaccgacggccgccgatgggcccagggtctggcagattcgatctgtgcggccagtgccagcagcgtcgcctcgtcatacggccggccgacgagttgaaccgacatgggcaggccgtcgccgtcgaagtcccacggcaccacggccgcgggctggccggtcagattccagacttgaaagtacggaacccgctgcaccaccagcagcaacgtcgaaactgcaccccggcgttggtaggcgccgatgcgggacgggccggtcgcggcgcctggcgtcacaactacgtcgacatcgtcgaagatcgactggatcggctgctcacaccactcggcggccgcaggccgccatccgccgtc

SEQ ID NO: 182 - DNA, 477 bp, Mycobacterium tuberculosis
agctttttgagcgtcgcgcggggcagcttcgccggcaattctactagcgagaagtctggcccgatacggatctgaccgaagtcgctgcggtgcagcccaccctcattggcgatggcgccgacgatggcgcctggaccgatcttgtgccgcttgccgacggcgacgcggtgggtggtcaagtccggtctacgcttgggcctttgcggacggtcccgacgctggtcgcggttgcgccgcgaaagcggcgggtcgggtgccatcaggaatgcctcaccgccgcggcactgcacggccagtgccgcggcgatgtcagccatcgggacatcatgctcgcgttcatactcctcgaccagtcggcggaacagctcgattcccggaccgcccagcgcattggtgatggaatcggcgaacttggccacccgctgggtgttgacatcctcgacggtgggcaattgcccccggtaacgtttgccgcct

SEQ ID NO: 183 - DNA, 461 bp, Mycobacterium tuberculosis
  modified_base (374): a, t, c or g
  modified_base (434): a, t, c or g
cggtccgaccctgttcgacggctacctgaatcaacccgatgccaccgccgcggcgttcgacgccgacagctggtaccgcaccggcgacgtcgcggtggtcgacggcagtgggatgcaccgcatcgtgggacgcgagtcggtcgacttgatcaagtcgggtggataccgggtcggcgccggtgaaattgaaacggtgctgctcgggcatccggacgtggcggaggcggcagtcgtcggggtgcccgacgatgatctaggccagcggatcgttgcctacgtagtcggctcagcgaatgtcgatgcggacgggcttatcaactttgttgcccaacaactttcggtgcacaagcgcccgcgcgaggtgcgtatcgtanatgcgctgccgcgcaacgccttggggaaagtgctccagaacattgctgtcagaagctganctacgcgaattatcgtgttacgctgga

SEQ ID NO: 184 - DNA, 440 bp, Mycobacterium tuberculosis
atactcaagcttgccgaagttccgatgggtcgcgccggcgagcccagcgaagtcgctaccgtggccgtgttcttggcttcggatctatcctcgttcatgaccggcaccgtgttggacgtgactggcggccggtccatatgacaccgagatcattgccacggtacggcaattcgtcaagaaggaaatctttcccaatgcaccggccctcgaacgtggcaacagctacccgcaagaaatcgtcgatcggctgggtgttattggcttgctcggtcgccggctgcaagggtatcgacaccaccgagttcattctcgggcgtgccggcgcattcgagctggcggtgcgcgctgcccagcaccgtcataggtacttgacgatggtccacgtcggacgagcgcctccacgtcgctgccgaacggtatgcatggcggctacgattctc

SEQ ID NO: 185 - DNA, 515 bp, Mycobacterium tuberculosis
cggtgtcggcaccggcgtcctgcagttggtaggcctgcagtttgtgcatcaggccgatgccgcggccctcgtggccacgcatgtacagcaccacgccgcgcccctcacgggcgaccatcgccagcgcggcgtccagctgaggcccgcaatcgcagcggcgtgacccaaacacatcgccggtcaagcactccgaatgcacccggaccagcacgtcgtcaccgtcggcgttgggcccggcgatctcgccgcggaccagcgcgacatgttccacgtcctcgtagatgctggtgtagccgatggcgcgaaactccccatgacgagtcggaatccgcgcctcggcgacccgctcaatgtgcttctcgtgcttgcgccgccattcgatcaagtcagcaatggtgatcagcgccagaccgtgctcatcggcgaacaccgcaattcatcggtgttgcgccatcgagccctcatctttttggctgacgatctcgcaaatcgcccccgcgggttgcagccggcat

SEQ ID NO: 186 - DNA, 345 bp, Mycobacterium tuberculosis
  modified_base (256): a, t, c or g
atactcaagctttgggtgaaagccgatcaccggaagccgcatgatcagccacgtttcgcgccgcccggcatacggcggcgtaccgatctccgcgtcatacacccgcgggtaatcgccgacggtgccggttcgcgagccgaaggtgacgacgctgattgaatcgagttccaggtccagcgggtggcgcagcaacggcgcgagctcaacgacgtcaatcacgttgtcgctttctacggtcaccgacccggtgaccgtnctcgcccggtgcgctcggccgataagttgcaccgccaccaccgcgacaccgtcttgcacgcggacccacccccggatccgttgttggcc

SEQ ID NO: 187 - DNA, 366 bp, Mycobacterium tuberculosis
  modified_base (322): a, t, c or g
agcttgctggcatccgctccagtagcgccccgcgcgtggcttccagcgcccgcagatgctccatgagccggccggtcgagtcggcgccggcgttcaccgccacccgccaggagctggcggccagcatctccgccttcacgcattgcgcgatcacagagagaatatacgtctcatattcgttggaggtcgtcgcaggcaatcggtcgatgacggatttgatggcatcgagctgtgcttcggcgtagccctccagcacgtcggtatcgctgtggcggtccacgacgaccgcaccggcgcggcggacagccgtcgggttggacgntgtgcggcgatcagtccggccagctccgcctcgggatcagcggc

SEQ ID NO: 188 - DNA, 423 bp, Mycobacterium tuberculosis
  modified_base (316): a, t, c or g
  modified_base (319): a, t, c or g
atactcaagcttgctgcagcttcctatgactgctcccgaaacctgggggtgtgcctgctgtgtatgcacggcatacggacatccttcccctgagacccgcggtcgaaccagccacgtgtccatcatcaggggtcaaccccggccaagggcgacggcacgccaagttcgccgaccgttaacctagtgctgttagcttcatttgctgcgagcaaaacagctggtcggccgttaggaactgaattgaaactcaaccgatttggtgccgccgtaggtgtcctggctgcgggtgcgctggtgttgtccgcgtgtggtaacnacnacaatgtgaccgggggaggtgcaaccactggccaggcgtcggcgaaggtcgattgcggggggaagaagaactcaaagccagtgggtcgacgcgcaggccaacgc

SEQ ID NO: 189 - DNA, 453 bp, Mycobacterium tuberculosis
agcttgacgcggagacggacacattgcgaacattgatgacaaaatagaaatcattgatggtttgagtcaccaggccgatcaagccttcgccgagccaaattccaatcaagaggcccaagcccgtaccaatcagcccggcaacgagggattccgtcattatcagccaaaataactgctctcgggttacacccaaacagcgcaatatggcgaaaaacggtcgccgttgcacgacattaaatgtcacggtattgtagattaaaaagatacccaccaacaaggcaatcaaactgagagcggttaaattgaccgtaaaagcgtccgtcatctgtttgacggtgtcccgttgggtatccgacgtttccatacgcacaccggccggcagtctttgttggatgcgtgttgcagtggcctcatctttgatgatcaaatcgatgtggctcagtcttccgggca

SEQ ID NO: 190 - DNA, 402 bp, Mycobacterium tuberculosis
  modified_base (342): a, t, c or g
  modified_base (344): a, t, c or g
  modified_base (389): a, t, c or g
  modified_base (395): a, t, c or g
atactcaagcttcggctcaggcggcgctgctggtaaagtcgctgaccggtgcaggtttcgacaatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtccgctcggatagcgaggtcagcgaattcncntggcagctccaaagggtcctgccggtgccggtctttgcgcaaacnaaggcncaggtta

SEQ ID NO: 191 - DNA, 427 bp, Mycobacterium tuberculosis
  modified_base (420): a, t, c or g
tgatcgcgcatcacctgcttcataaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacagcgcgttctccaccgaccgggcccgggtgtggggtgtttcggcgaccggcagccaggtggtccacactgccgacgggcgccgcgagccgttcaccgaccaggccgccgagcaagtccgcccgatcgcatactccaaccggttgcggtactgcaggttcagctggcgtactcctcgtcgcgctcggcgaggtcttgctccagcacgtcgcanacggcag

SEQ ID NO: 192 - DNA, 347 bp, Mycobacterium tuberculosis
  modified_base (347): a, t, c or g
caaagcgcgaactgctcgcggcagcccacgacgtgctgcgtcggattgccggcggcgaaatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccagcgtgatcaggctcggctcgcgagttccgggaagaagtggctccgcctgatcacctaccatccgccaggatctgcgtgtcttcaccacgcccgccaaggaggttgttgtggtgctatcgaccgn

SEQ ID NO: 193 - DNA, 330 bp, Mycobacterium tuberculosis
  modified_base (227): a, t, c or g
  modified_base (253): a, t, c or g
  modified_base (287): a, t, c or g
ccggaagccgcatgatcagccaagtttcgcgccgcccggcatacggcggcgtaccgatctccgcgtcatacacccgcgggtaatcgccgacggtgccggttcgcgagccgaaggtgacgacgctgattgaatcgagttccaggtccagcgggtggcgcagcaacggcgcgagctcaacgacgtcaatcacgttgtcgctttctacggtcaccgacccggtgaccgtngtcgcccggtgcgctcggccgaaaanttgcaccgccaccaccgcgaaaccgtcttgcacnccggaagccacccccgatccgttgttgggccaggttattgggt

SEQ ID NO: 194 - DNA, 215 bp, Mycobacterium tuberculosis
  modified_base (87): a, t, c or g
  modified_base (179): a, t, c or g
  modified_base (196): a, t, c or g
ccggaaccgccgacggcacggtataacgcctccgcatatgggtcgacaaccagcgggtcggacttctgggcttctagcgttcgcgcngtcgcgacaaacagcgcggtcgaaccgacactcgttgtgatgtcctagctatcacgttcggtacgcacccaatcgagtctagcgcgggtagntcagccccgatctccangctccgccgagccaggcgc

SEQ ID NO: 195 - DNA, 225 bp, Mycobacterium tuberculosis
ctggtttatgtcccgttgaagttccatcacccgatgtggcgggagcactgccaggtcgatctcaactaccacatccggccgtggcggttgcgcgccccggggggtcggcgcgaactcgacgaggcggtcggagaaatcgccagcaccccgctgaaccgcgaccacccgctgtgggagatgtacttcgttgaggggcttgccaaccaccggatcgcggtggttgcc

SEQ ID NO: 196 - DNA, 161 bp, Mycobacterium tuberculosis
  modified_base (26): a, t, c or g
  modified_base (87): a, t, c or g
ccgagcagttgggaatcgctctgcancaaaccaatattctgcgcgacgtcgcgcgacgagctggaccgattaggcgtacgcctccgnctggacgacaccggggcactcgatgaccccgacgcctacgctcgcaggatattgttcgccggacccctctctag

SEQ ID NO: 197 - DNA, 240 bp, Mycobacterium tuberculosis
tatataatactcaagcttgccgacgccaacgctcgcgcgatgttgttagcccgacccggctcttacatggcaccggtgccccacacgtcagcctgtgacgtcctgcaccgcgactctttacatagaatgtggattgccggattggggatgtccggcatcgctcaatctgtagtccgcgttgtcccgcgagggccatgtggatggggggaaggatccgtggcgtccgggatcaccatgggg

SEQ ID NO: 198 - DNA, 348 bp, Mycobacterium tuberculosis
atactcaagcttgccgaagttccgatgggtcgcgccggcgagcccaacgaaatcgctagcgtggccgtgttcttggcttcggatctatcctcgtacatgaccggcaccgtgttggacgtgactggcggccggttcatatgacaccgagatcattgccacggtacggaaattcgtccagaaggaaatctttcccaatgcaccggccctcgaacgtggcaacagctacccgcaagaaatcgtcaatcggctgggtgttattggcttgctcggtcgccggctgcgagggtttctacaccaccgagttcattctcgggcgtgccggcgcattcgaactggcggtgcgcgctg

SEQ ID NO: 199 - DNA, 371 bp, Mycobacterium tuberculosis
  modified_base (307): a, t, c or g
gcaccggcgtcctgcagttggtaggcctgcagtttgtgcatcaggccgatgccgcggccctcgtggccacgcatgtacagcaccacgccgcgcccctcacgggcgaccatcgccagcgcggcgtccagctgaggcccgcaatcgcagcggcgtgacccaaacacatcgccggtcaagcactccgaatgcacccggaccagcacgtcttcaccgtcggcgttgggcccggcgatctcgccgcggaccaacgcgacatgttccacgtcctcgtagatgctggtgtagccgatggcgcgaaactccccangacaagtcggaatccgcgcctcggcgaaccgctcaatgtgcctctcgtgcttgcgccgccattc

SEQ ID NO: 200 - DNA, 165 bp, Mycobacterium tuberculosis
tggtccgtgtgcgcataccaatacaacgcgccgggcacctgacgcggcggccgcaaccaatcggtggccatcgccatcttctgctacccggtcaacggacgcaccttctcctggccgacgtagtgcgcccacccgccgccgttgcgtcccatcgatccggtcaac

SEQ ID NO: 201 - DNA, 390 bp, Mycobacterium tuberculosis
ggcgtgttggccaccggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctaaagccactggcgatcggtgccgatcgtggggaacccactggcgaacctggttcaaccaaacttgaaggtgattgtttacctgggctacggcgacccggcctatggttattcgacctccccgcccaa

SEQ ID NO: 202 - DNA, 427 bp, Mycobacterium tuberculosis
  modified_base (9): a, t, c or g
  modified_base (18): a, t, c or g
  modified_base (25)..(26): a, t, c or g
  modified_base (154): a, t, c or g
cgtccgtgncccctcaancgcgtgnngccgaagcggctggttacgactccctgtttgtgatggacacttctaccaactgcccatgttggggacgcccgaccagccgatgctggaggcctacacggcccttggtgcgctggccacggcgaccgancggctgcaactgggcgcgttggtgaccggcaatacctaccgcagcccgaccctgctggcaaagatcatcaccacgctcgacgtggttagcgccggtcgagcgatcctcggcattggagccggttggtttgagctggaaacaccgccagctcggcttcgagttcggcactttcagtgaccggttcaaccggctcgaagaggcgctacagatcctccagccaatggtcaagggtgagcgcccaacgtttttcggcgattggtacaccaccgaatc

SEQ ID NO: 203 - DNA, 498 bp, Mycobacterium tuberculosis
  modified_base (22)..(23): a, t, c or g
  modified_base (32): a, t, c or g
  modified_base (379): a, t, c or g
  modified_base (455): a, t, c or g
ccgcttccgtgtaaccgagcanngcgagcganctggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactatcccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccnccctcaaatctgtgacagataaccctcagactatcctgtcgtcatggaagtgatatcgcggaaggaaaatacgatntgagtcgtctggcggcctttctttttctcaatgtatgagagcg

SEQ ID NO: 204 - DNA, 265 bp, Mycobacterium tuberculosis
  modified_base (107): a, t, c or g
  modified_base (156): a, t, c or g
  modified_base (165): a, t, c or g
  modified_base (168): a, t, c or g
tgacacccaacagagggcacttaagatggcaatgcggccgcctacctgcacgttttcgcgatgtcagaggatgccgagggagaacaatgcgagcacggccgctgacnttgctcaccgctttggcggcggtgacattggtggtggttgcgggctgcnaggcccgantcnaggccgaagcatatagcgcggccgaccgcatttcgtctcgaccgcaagcgcgacctcagccgcagccggtggagctactgctgcgcgccatcacgcc

SEQ ID NO: 205 - DNA, 369 bp, Mycobacterium tuberculosis
acgggcgacgctgaggtgggcccgcggctattcatgctgtcgtccacgtccagcgacgcactgcgccagacggcccgccaactagccacctgggtggaagaacaccaggactgcgtggcggcctcggatctggcctacacgctggcgcgtggccgcgcgcaccggccggtgcgcaccgcggtggttgccgccaacctgccggagctcgtcgagggtttgcgcgaggtggccgacggtgacccctctatgacgcggcggtgggacactgtgatctaagaccggtctgggtcttctccgggcaagggtctcagtgggcggcgatgggcacccaattgctcgccagcgaaccagtgttcgcggccaccatcg

SEQ ID NO: 206 - DNA, 428 bp, Mycobacterium tuberculosis
  modified_base (280): a, t, c or g
atactcaagcttcgcgagatccggatggcactcacgctggacaagaccttcacaaaatctgaaatcctgacccgatacttgaacctggtctcgttcggcaataactcgttcggcgtgcaggacgcggcgcaaacgtacttcggcatcaacgcgtccgacctgaattggcagcaagcggcgctgctggccggcatggtgcaatcgaccagcacgctcaacccgtacaccaaccccgacggcgcgctggcccggcggaacgtggtcctcgacaccatgatcnaaaacttcccggggaggcggaggcgttgcgtgccgcccagggcgaaccgctgggggttctgccgcagcccaatgattgccgcgcggctgcatcgcgggcggcgaccgccattcttctgcgaatacgtccaggagtactgtctcggggc

SEQ ID NO: 207 - DNA, 378 bp, Mycobacterium tuberculosis
  modified_base (304): a, t, c or g
agcttatgtggccgcccacctaccttatctagcctagctaactaaatccagtgccgacagtgcgcggctggccacccagcatgaggttatgaccacggcatatgccagcgcgctggcggcgatgccgacgctgaccgagttggccgctaatcacaccagccatgcggtgttgctgggaacgaatttctttggaatcaatacgatcccgatcgcgctcaatgaggccgactatgcgcggatgtggattcaggcggccaccacgatgagtatctatgagggcacctccgatgcggcgctggcgtcngcaccgcaaaccacaccggctccggtactgttcaacggcggtgctggcgtttgccagcgcctgccggcgatctc

SEQ ID NO: 208 - DNA, 284 bp, Mycobacterium tuberculosis
  modified_base (117): a, t, c or g
atactcaagcttgccacccatgccgagcaaggtcgactcagcgatgacgaattgttcttcttcgcggtgttgctgctggttgcgggctatgagagcactgctcatatgattagcacnttgtttctgacgctggccgactatccagatcagctgacactccttgcgcagcaaccagacctgatcccgtcggcgatcgaggagcacctccgctttatatcgcaatccaaaacatctgccgcacaacgcgcgtcgactattcggtcggtcaagcggtcatcccggga

SEQ ID NO: 209 - DNA, 236 bp, Mycobacterium tuberculosis
ccggggtagaacgatgcgatctgggccatgtcgacatcggtggtacaggtaaaccgcgccgtgtgcgcggtctcggagatcagaacgtggtcgcagttgacaccgcgggctttcagccagtcgcgataatcggcgaagtcggcgcctgccgccccaactagcgcgacctcgccacctagcacaccgatggcgaaggccatgtttccggccacgccgccgcggtgcatcatcaactc

SEQ ID NO: 210 - DNA, 278 bp, Mycobacterium tuberculosis
atactcaagcttggcggcaacgccactaccgggctcaccaggtcctgtgccgccaccgccggcgccgaaagcaccatcaggtcgtagttgtctggacgttcgacaccgtaagcgaacacaatgccgccgcccatgctgtgcccgagcacgatgcgcttgcacccgggatattcccgggtggcgatcccaacgagggtgtcgaagtcagcggtgtatctgagatgtctctcactatcatccgtttggcacccgagcgggcatgcccgcggggggtcaac

SEQ ID NO: 211 - DNA, 360 bp, Mycobacterium tuberculosis
  modified_base (303): a, t, c or g
gtcgacggcatcaaggtccgcagtgatggtgttcatctcacccaggaaggcgtgaagtggctgataccgtggcttgaggattcggtgcgggtcgccagttaatccgccgtgtgctccggatgagcgcgacggtaaccctggaattgtgctgtgtgctggctgtgtcgttgtgatgagcctgtctaagtggtgcgtaaccgtttgacgagccgcggcctcgctgcaaacattgaagcccgcacgtctgggtttgtatttacacaacgagggcgctccccgatctggcgcgcgcaacgaggtgcncactatccattcgaggtgaactggactccttgatgctcatgccggtgcggttttgtc

SEQ ID NO: 212 - DNA, 256 bp, Mycobacterium tuberculosis
atactcaagcttgcgttcgatgaagtagtcgtcggtcagcgccgcctcttcgagctccttggcgatgcccagcaaggagtcatcgccgccgagcttggccaggatcttgtcggcctgttccttgacgatgcgggcccgcggatcgtagttcttgtagacacgatgaccgaaacccatcaatttgaccccggcctcgcggttcttgaccttgcgttacaaactcgctgacgtcgtcgccgctgtcgcgaatgccctc

SEQ ID NO: 213 - DNA, 262 bp, Mycobacterium tuberculosis
  modified_base (1): a, t, c or g
  modified_base (24): a, t, c or g
ngtcaagccgagcatgcgcgaggnaacgacgaacccaacaagccatggtggttggcgccgtcgagaggtcggcggtcgccacaacgggaagatcgccttgagcgtcgctcgaccgccgcctcgagttgggtcataacgaagtagctgatgccgatcatgtcgacgtttccgtcgcatcagcgtgcagcggcgacccactcgacgaggtctcggtgccgccgcggccagggcaccagcagtgacgattccaggcgccgtcggg

SEQ ID NO: 214 - DNA, 336 bp, Mycobacterium tuberculosis
  modified_base (336): a, t, c or g
cgataatcgcttccggtaagtgcagcagctttacgacggcgactcccatcggcaatttctatgacaccagatactcttcgaccgaacgccggtgtctgttgaccagtcagtagaaaagaagggatgagatctccccgtgcgtcctcagtaagcagctcctggtcgcgttcattacctgaccatacccgagaggtcttctcaacactatcaccccggagcacttctagagtaaacttcccatcccgaccacatataggctaaggtaatgggcattaccgcgagccattactcctacgcgcgcaattaacgaatccaccatcggggccgctggtgtcn

SEQ ID NO: 215 - DNA, 259 bp, Mycobacterium tuberculosis
  modified_base (1): a, t, c or g
  modified_base (243): a, t, c or g
naatactcaagctttctcgtgattaccacccgtgtaatttgggatgggcaaaaaggcgaatcaccgcgtggccacaaacgccgggagggacaatctcgggcggctagggcttctcgcgggaaggcccgaacgtacggcgtttcaacacgtcgcgtcgccctccgaccgcgaacattcggggatggcagcaacctggtatcaccctggccgggcaatgatctgcagcgtcgccgcgggtagtgnccgcccgggcggctac

SEQ ID NO: 216 - DNA, 325 bp, Mycobacterium tuberculosis
ccaactagagcatcgggacatacggagtcaactacccggccaacggtgatttcttggccgccgctgacggcgcgaacgacgccagcgaccacattcagcagatggccagcgcgtgccgggccacgatgttggtgctcggcggctactcccagggtgcggccgtgatcgacatcgtcaccgccgcaccactgcccggtctcgggttcacgcagccgttgccgcccgcagcggacgatcacatcgccgcgatcgccctgttcgggaatccctcggggccgcgctggcgggctgatgatcgccctgacccctcaattcgggtccaaga

SEQ ID NO: 217 - DNA, 300 bp, Mycobacterium tuberculosis
atactcaagcttgctgcagcttcctgtgactgctcccgaaacctgggggtgtgcctgctgtgtatgcacggcatacggacatccttcccctgagacccgcggtcgaaccagccacgtgtccatcatcaggggtcaaccccggccaagggcgacggcacgccaagttcgccgaccgttaacctagtgctgttagcttcatttgctgcgagcaaaacagctggtcggccgttaggaactgaattgaaactcaaccgatttggtgccgcccgtaagtgtcctggctgccggtgcgctggtgtt

SEQ ID NO: 218 - DNA, 265 bp, Mycobacterium tuberculosis
agcttgcgcggcgtggcgatcgcggttcaaggcgcgctcttcgagcacaacgagcgaagacagctcggcgacggagcctttatcgacatccgttcgggctggctgaccggcggcgaagaactgctggacgcgttgttgtcgacggtgccgtggcgagccgagcgccgtcagatgtacgaccgggtggtcgatgtgccgcggctggtgagttttcacgacctgaccatcgaagatccgccgcatccgcagctggcgcggatgcgcc

SEQ ID NO: 219 - DNA, 362 bp, Mycobacterium tuberculosis
  modified_base (101): a, t, c or g
  modified_base (104): a, t, c or g
aatactcaagcttgcgcacgaccaggacgtcgagtggcgcttgcagtgacttggcgacctcaaaggccaccggtaccccgccgcgcggcaagccaaggacnacnacggccttgccggatagctgcgccaggcgttgcgccaactggcgtccagcgtcgccacgatcgtcaaagagcttcatctgccgagtgtgtcgccatctcatggctccaaatatggaattaggtccctgggccgactgacgacagtccctcagcgaccggattgcgcatcccgccttgtacgctgctccgcaaatcccgggcttgcgtccgcggaagcgaactcggcggcgctacggtggtggctcacttcggccgtgc

SEQ ID NO: 220 - DNA, 486 bp, Mycobacterium tuberculosis
ggttggtgcggtccaccttcgcggcggcggcgcgatatgccttgctggtcttgctcatttgatatccaatctatgggtcgtggttactcagcgggccgaagctggccctcccacgggtagggccctattcgacggtgatgcccatcgaccgagcggtaccggcgatgatcttggccgcagcgtcgacgtcgttggcgttgaggtccgtcttcttggtctcggcgatttcgcggacttgatcccaggtgactttggcgaccttggtcttgtgcggctccgccgaacccttcgccacaccagcggccttaagcagcagcttggcggcgggcggcgtcttcagcgtgaaagtgaagctacggtcttcataaacggtgatctccaccgggatgacgttgccgcgctggttctccgtcgcggcgttgtacgccttgcagaactccatgatgttgacccgtgctgaccgaacgcggggcccactggcggggc

SEQ ID NO: 221 - DNA, 373 bp, Mycobacterium tuberculosis
  modified_base (229): a, t, c or g
  modified_base (265): a, t, c or g
atactcaagcttttcgacccgcaagccggcggtgcccctcctcgttccgctgcccggtctgctcgatcggttcggggtcgccgcgctaggcccaattgcccggctcctcctcgggccgttccacaacccgcatcgtcgccgggctaggttcaagccatgccggtaaaccccaggacgccagtgctgatcggctatggacaggtcaaccaccgaggcgacatcgacgccnaaaatcagtccatcgaacccgtcgacctgatggccnccgcggcccggaaagccgccgagtccaccgtgctcgaagcggtggattccatccgtgtggtgcacatgctgtcggcgcattaccggaattcccgggcgtctcctcggc

SEQ ID NO: 222 - DNA, 331 bp, Mycobacterium tuberculosis
  modified_base (1): a, t, c or g
  modified_base (307): a, t, c or g
ncctggttcatgaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacagcgcgttctccaccgaccggggccgggtgttggggtgttcggcaacggcaaccaagttggtccacactgccgacgggcgccgcaaatccgttcaccgaaccaggccgccnaaacaattccgcccgatcccatat

SEQ ID NO: 223 - DNA, 377 bp, Mycobacterium tuberculosis
  modified_base (377): a, t, c or g
atactcaagcttgtcgggatcaatctcgagggcatccacgcacgaaaagtaaactctatcaagctttttgacgacacccacggacgccccatatatgttcgggtgggcaagaacggtccctacctggaacgtttggtggccggcgacaccggtgagcccacgccgcagcgggccaacctcagcgactcgattaccccggacgaactgactctacaggtggccgaagagctctttgccacaccgcaacagggacggactttgggcttggacccagaaaccggccacgaaatctttgccaggggaaggccggtttgggccttatgttacctatatcctgccggaacctgcggctgatgcggccgcggccgctcagggan

SEQ ID NO: 224 - DNA, 436 bp, Mycobacterium tuberculosis
agcagctagccgcgctcgccgcgctggtcggtgcgtgcatgctcgcagccggatgcaccaacgtggtcgacgggaccgccgtggctgccgacaaatccggaccactgcatcaggatccgataccggtttcagcgcttgaagggctgcttctcgacttgagccagatcaatgccgcgctgggtgcgacatcgatgaaggtgtggttcaacgccaaggcaatgtgggactggagcaagagcgtggccgacaagaattgcctgggctatcgacggtccagcacaggaaaaggtctatgccggcaccgggtggaccgctatgcgcggccaacggctggatgacagcatcgatgactccaagaaacgcgaccactacgccattcaagcggtcgtcggcttcccgaccgcacatgatgccgaagaattctacagctcctccg

SEQ ID NO: 225 - DNA, 539 bp, Mycobacterium tuberculosis
  modified_base (18): a, t, c or g
cgcgactggctccccggncggctgctcgggtccgccgatagagaccgggatgtcgcccgacgacgggcagccgggttgcgtgggacggggcgggggtcgggcagcccaagcaacgggctagtccccgaatcctacggagccgtcacctacgcctacgtaatagtagctatcaataacagttgacatacgcaacgatctgtgagatcaatattgcctgacgcatgtcaagacaggcgtcaagacaggtgtcaataattcgctccgctggtgacggtaaccggtcgtgcgggtgtgtgacgcctaaggaaggagtgtgggtggtgacgctgagagtggttcctgagggtttggcggccgccagtgcggcggtggaggcgttgaccgcacggctggccgccgcacacgctggcgcggcgccggcgattacggcggtggtggcgcccgcggcggatccggtgtcgttgcagaatgcggtggggtttagcgccttaagtagccagcatgccgcgatcgccggcgaaagggtccaagaactgggt

SEQ ID NO: 226 - DNA, 517 bp, Mycobacterium tuberculosis
  modified_base (304): a, t, c or g
atactcaagcttattgaaccgcgggtcgcaggcaaagtggacctcataacgactcgggtccagcgaccgcgccaacacgaacggccggacgacgtgggccagggtcgcggcctcccctacaaacaggatccgttgcctgcgaacgacaggctccggtgcggcgttgggcgccgtgctcgtcccagcgtccggtcccgggtcgccggcgacgcttgtttcctccatactcgccccctaatctcgaggcagcccgtacccgcaggcaacctcccaaaaatgcaatcccgcaaaatgcaatgcgtcnagctatttctcacaccgaccgctagttgcggatcagaaatccgttgggcgcggaagtccagccgaatttgttctcccgctccgcatcatgcttgtaatcgtttggaaattcatcctcatatgcctcgatcgcttcatagggtccaggcccaaacccgggcaggactgggtggccgttgatgttggaatcctccactactaggtattcaccggc

SEQ ID NO: 227 - DNA, 488 bp, Mycobacterium tuberculosis
gtctcgatcatggccaaagagctcgacgaagccgtagaggcgtttcggacccgcccgctcgatgccggcccgtataccttcctcgccgccgacgccctggtgctcaaggtgcgcgaggcaggccgcgtcgtcggggtgcacaccttgatcgccaccggcgtcaacgccgagggctaccgagagatcctgggcatccaggtcacctccgccgaggacggggccggctggctggcgttcttccgcgacctggtcgcccgcggcctgtccggggtcgcgctggtcaccggcgacgcccacgccggcctggtggccgcgatcggcgccaccctgcccgcagcggcctggcagcgctgcagaacccactacgcagccaatctgatggcagccaccccgaagccctcctggccgtgggtgcgcaccctgctgcactccatctacgaccagcccgacgccgaatcagttgttgccaatatgatcgggttctcgac

SEQ ID NO: 228 - DNA, 264 bp, Mycobacterium tuberculosis
atactcaagctttcgtcagttcatggcgccagcagaccaacaagagcatcgggacatacggagtcaactacccggccaacggtgatttcttggccgccgctgacggcgcgaacgacgccagcgaccacattcagcaaatggccagcgcgtgccgggccacgaggttggtgctcggcggctactcccagggtgcggccgtgatcaagatcttcaccgccgcaccactgcccggcctcgggttcacgcatccgtttggccgccgcc

SEQ ID NO: 229 - DNA, 229 bp, Mycobacterium tuberculosis
gccccgtgtaatttgggatgggcaaaaagcgaagcaccgcgtggccacgaacgccgggagggacaatctcgggcggctagggcttctcgcgggaaggcccgaacgtacggcgtttcaacacgtcgcgtcgccctccgaccgcgaacattcggggatggcagcaacctggtagcaccctggccgggcgatgatctgcagcgtcgccgcgggtagtctccgcccgggccgc

SEQ ID NO: 230 - DNA, 266 bp, Mycobacterium tuberculosis
atactcaagcttcctttgaccgaacgcgtccaccgcaccgtgagattggtggcgccattcgtcgtggtgtagctgctgttggcggcgtcgccgtattgtgcgggccagccttgtgcgggggccgcttctacccacaagtcggcacttccgcaaccgcccagctcgaccgcgaattacggcggccgcaacggccgccggaaggcgtcacgcaatcgcttatcctttccaggttcccaaatcctccgcttacttgggtccttcatcgg

SEQ ID NO: 231 - DNA, 258 bp, Mycobacterium tuberculosis
  modified_base (207): a, t, c or g
ggcagcggcgacaaccggaacgtccgcacggtgctcaatcacgggtgcacggtgtgcatcagaatggcgggggttcgttgtcgcggtgaggcgttcggcgaggaggtagtgtctaccccttgcccgcgggttcgtgcggactgaaagggatttcattgggaacccacggctgcgtatcgcagggcctcggtgacgtctgcttcctcnagctcaggaagttcggcgagaatctcggtggatgttatttggtccgcctac

SEQ ID NO: 232 - DNA, 224 bp, Mycobacterium tuberculosis
atactcaagctttctcggcttctctgatagcctgagaagaaaccccaagttaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttattcattgttttgcgtt

SEQ ID NO: 233 - DNA, 333 bp, Mycobacterium tuberculosis
atactcaagcttggtgaccggcaccgcgatacgttgcggcaggcatctgggctggcggtggttcgccgctccgaagccgtcgaacaccatcgccagcgcggcttccacatcaacgaccatttcggccagcttgcggcgcatcagcggcttgtcgatgagcgccccaccgaatgcccgccgctgcccggcgtatcacatcgattcgaccatcgcgcggcgcgcgttgccgagggcgaacgaggcggtgcccaaccgcaatctgtttggtcagctccctcatgcgggttgattccttgccgtccggacgggcccgcgtcatgcgctcggttcgcc

SEQ ID NO: 234 - DNA, 407 bp, Mycobacterium tuberculosis
ccgttgcgcagcgtgagccgatagttgacatccggctcggtgaaggtgaaatcgatggccaggtcgaggtcccatgcgcgtgggccattgatgctgatcgccaggacgtcaaagatttggtccggcgtcagctgggcgaaaaacgtgggcgccgggacttgcccggagctgcccgggttcccgtcgcgcagctcggcggccccggtcagaaagaaattgcgccaggtcgcacactccgcgccgtaggccagctgctccagggtgtcggcatagagcccgcgggccgcagcgtgctcgctgtcggcgaacaccgcatggtcgagaagcgttgccgcccaacgggaaatcacctgcgtcgaaagcttcgcgggccagctccagcactcggtcgatgccacccaacgcgt

SEQ ID NO: 235 - DNA, 389 bp, Mycobacterium tuberculosis
  modified_base (46): a, t, c or g
atactcaagcttgcggatgttacccctgacagcgtgaactatgtcnaaacacacggcaccggaacggtgttgggggaccccatcgagttcgagtcgctggcggccacttatggcctgggtaaaggccagggcgagagcccgtgcgcattggggtcggtcaaaaccaacatcggccacctggaggcggccgccggtgtggctggattcatcaaggcggtgctggcggtgcaacgtgggcacattccccgcaacttgcacttcacccggtggaacccggccatcaacacgtcggcgacgcggctgttcgtgccgaccgaaagcgccccgtggccggcggctgccggtccacgcagggctgcggtgtcatcgttcggcctcagcgggaccaa

SEQ ID NO: 236 - DNA, 432 bp, Mycobacterium tuberculosis
  modified_base (365): a, t, c or g
ccggtaaccagatcagctcgtcgacctcactgccgggggtgaattccccaccggtgctgcgcgctgcccagtagtgcaccttcttgacgcctcgaaaaggggagtcggtcgggtaggtcaccgtcaggagccgcctacccaggttggcgcggtgaccggtctcctcgagtatctcccgcaccgcccccaccggtgcggtctcgcccggatccactttgcccttgggcagcgaccagtcgtcgtaacgggggcggtgaatgacagcgatctcgaccggcccttccgaatcggcactgccgggtcgccagaacaccgcaccggcggcgtacacaatccggcccgccgagcgccggcgggcggacganttctggatcgacacctcaactcctgcaggtcaattcggccaagctgctcgcggtcgtggatgtggtc

SEQ ID NO: 237 - DNA, 287 bp, Mycobacterium tuberculosis
atactcaagcttgatgccgccgaaaccgagcgtgagcacgccgccacccaccacgcgcgggtcgggcgccgggcccgggccgccaggctgctccgctcggtgatggcacgccaccgcgacaccacccggctgcgctacgtcgagccataccgggcggagctacatcggctcggccgcccagtgttcgggccctctttcgaggtcgaggtctataccgatttgcgcatccgcagccgcaccctggtcgtctcgtaccgtgccctacctctgcttgtcgggcggggcca

SEQ ID NO: 238 - DNA, 272 bp, Mycobacterium tuberculosis
tccgtacggcccgggtacgcttcggtcgcagtgtgcgagtgatagatgacgaccgggacctcgtcggcatcttccatagcccgccacaccttcagttgctcaccggaatccaaccggtagaaggtcggcgagcgctcggcattggtcatcgggatatgccgctcgggacggtcagagccctcgggtccggccagcactccgcaggcttcgtcggggtggtcgcgacgcgcatgggccaccatccatccaccaggtctgcgcgaatcacccgc

SEQ ID NO: 239 - DNA, 410 bp, Mycobacterium tuberculosis
  modified_base (334): a, t, c or g
ggacacattgcgaacattgatgacaaaatagaaatcattgatggtttgagtcaccaggccgatcaagccttcgccgagccaaattccaatcaagaggcccaagcccgtaccaatcagcccggcaacgagggattccgtcattatcagccaaaataactgctctcgggttacacccaaacagcgcaatatggcgaaaaacggtcgccgttgcacgacattaaatgtcacggtattgtaaattaaaaagatacccaccaacaaggcaatcaaactgagagcggttaaattgaccgtaaaagcgtccgtcatctgtttgacggtgtcccgttgggtntccgacgtttccatacgcacaccggccggcagtctttgttggatgcgtgttgcagtggcctcatctttgatgatca

SEQ ID NO: 240 - DNA, 439 bp, Mycobacterium tuberculosis
gcctggcccaggtgaaggccgacctcgacgccaaagccgctgatccggcacatgagtcggtggactgggacttgaagtcgctgcgatgggcgtggaaccgagccaaagatgacgtggcgccgtggtgggccgagaattccaaggagtgctactcgtcggggttggccgatctggcccagggcctggctaattggaaagctggcaagaacgggacccgcaaaggccggcgggtgggcttcccgcgattcaaatccgggcggcgtgatcctggcagggtgcggttcaccaccggcaccatgcgcatagaggatgaccggcgcacgatcacggtcccggtgatcgggccgctgcgggccaaggagaacacccgccgggtgcaacgccacctcgtgagcgggcgcgcgcagatcctgaacatgaccttgtcgcagcggtgggg

SEQ ID NO: 241 - DNA, 356 bp, Mycobacterium tuberculosis
  modified_base (22): a, t, c or g
  modified_base (241): a, t, c or g
taactcaagcttcaagtccgcngtccgaccctgttcgacggctacctgaatcaacccgatgccccgccgcggcgttcgacccgacagctggtaccgcaccggcgacgtcgcggtggtcgacggcagtgggatgcaccgcatcgtgggacgcgagtcggtcgacttgatcaagtcgggtggataccgggtcggcgccggtgaaattgaaacggtgctgctcgggcatccggacgtggcggangcggcagtcgtcggggtgctcgactattatctaggccagcggatcgttgcctacgtagtcggctcagcgaatgtcgatgcggacgggcttatcaactttgttgcccaacaacttt

SEQ ID NO: 242 - DNA, 341 bp, Mycobacterium tuberculosis
  modified_base (309): a, t, c or g
ccatgtcgcccaacatatcgtcgatgttcgcgtcgtccgcctcgcgcacgtggtctgtcaccagtcaacgttaacgccgccgcacatgtcctgcggccgggcaaaaacgtgaaaaacgagcgggcgactgcaatgtcatgacaccgacgccgccgatgggcccagggtctggcagattcgatctgtgcggccagtgccagcagcgtcgcctcgtcatacggccggccgacgagttgaaccgacatgggcatgccgtcgccgtcgaagtcccacggcaccacggccgcgggctggccggtcagattccanacttgaaagtactgaagccgctgcaccaccag

SEQ ID NO: 243 - DNA, 336 bp, Mycobacterium tuberculosis
  modified_base (236): a, t, c or g
  modified_base (242): a, t, c or g
  modified_base (248): a, t, c or g
  modified_base (251): a, t, c or g
cgaaagcgtgaaacagctcgcggcagcccccgacgtgctgcgtcggatagccggcgggcgaagatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccagcgtgatcntgctcngctctntanttcggcgaagaagtggctcgcctgatcacctaccatcggccaggatctgcgtgtcatcacaacgctcgccaaggaggttgttgtg

SEQ ID NO: 244 - DNA, 337 bp, Mycobacterium tuberculosis
tccgccacgcttcgcgccgcccggcatacggcgcgtaccgatctccgcgtcatacaccgcgggtaatcgccgacggtgccggttcgcgagccgaaggtgacgacgctgattgaatcgagttccaggtccagcgggtggcgcagcaacggcgcgagctcaacgacgtcaatcacgttgtcgctttctacggtcaccgacccggtgaccgtagtcgcccggtgcgctcggccgagaagctgcaccgccaccaccgcgacaccgtcttgcacgcggacccaccccggatcggttgttggccaaggtaattgggtcattccatttgacgggacgccgaccc

SEQ ID NO: 245 - DNA, 337 bp, Mycobacterium tuberculosis
  modified_base (162): a, t, c or g
cattctttaacagttgttttgggctcggcatggttagccaacgttctgcggtccaccatatcatcttggtccggtagcgctcgtccggggtatgctgccgccgggattctcgctgctattactccccccgaagaaccgccaccggtccagcgcgtgggccgncgcggtcccatcacaaactgaacccccaacagggacatgcttatcggtagggcgcgcgccaaggcggcagcaatcgcatcactgcgctctgcgcgtcactattaacccacccggacttcacttccaccaccccgaatggcgcccggtcattgatcatctggcgcaccgcggataa

SEQ ID NO: 246 - DNA, 343 bp, Mycobacterium tuberculosis
  modified_base (267): a, t, c or g
cggtgtcctgcagttggtaggcctgcagtttgtgcatcatgccgatgccgcggcctcgtggccacgcatgtacagcaccacgccgcgcccctcacgggcgaacatcgccagcgcggcgtccagctgaagcccgcaatcgcagcggcgtgaccaaacacatcgccggtcaagcactccgaatgcaccggaccagcacgtcgtcaccgtcggcgttgggcccggcgatctcgccgcggaccatgcgcgacatgttccacgtcctcgtanatgctggtgtagccgatggcgcgaaactccccatgacgagtcggaatccgcgcctcggcgacccgctcaatgtgct

SEQ ID NO: 247 - DNA, 340 bp, Mycobacterium tuberculosis
  modified_base (196): a, t, c or g
  modified_base (199): a, t, c or g
  modified_base (211): a, t, c or g
cggcatctggcggctgaacctgttcttgggcaacatgccgaggatcgcctcttccaccacgcggtcggggtggcgttgcattacctcaccgatggtgcgcttgtgcaggccgccgggataccccgagtgccggtaaaccatcttgtgctgcagtttgtcgccgctgatggcgaccttgtcggcgttgatcacgatnacnaatcaccgccancgacattgggggcgaacgtcggctcgtgcttgccgcgcagcaggctggccgccgcgacgcaaggcgccaaccaccacgtccgtggcgtcgatgacgtaccaccatcgcgtggtgtcacccgccttgggc

SEQ ID NO: 248 - DNA, 322 bp, Mycobacterium tuberculosis
  modified_base (22): a, t, c or g
  modified_base (31): a, t, c or g
  modified_base (258): a, t, c or g
gcggcaaaaattgaagcactcntggccactnccgccgggagggacaatctcgggcggctagggcttctcgcgggaaggcccgaacgtactgcgtttcaacacgtcgcgtcgccctccgaccgcgaacattctgggatggcagcaacctgttagcaccctggccgggcgatgatctgcagcgtcgccgcgggtagtcgcccccgggcggctacagtctgaaacgcgatgaccatcgatgtgtggacgccgcatccgacncaacggttcctacactgtgatatgttcgcctcgctgcgccggtggacggtgggtctatcccgga

SEQ ID NO: 249 - DNA, 278 bp, Mycobacterium tuberculosis
  modified_base (191): a, t, c or g
cgcgttgaactgaaggggtgccgcccggctcgagcaggcaagccatttgttcgatgcggttaccgaagatctcttcggtgactgcccgccgccggccagctcggctcagtgtccggcgttggtcgccgcggcgacaatcttggcgtccacggtggtcggggtcatgcccgcgagcaggattggcgagcggncggtcagccgggtgaacttcgtcaagagctgacgctgcggttggggaggcgaatcatggtcggtgcgtagcctcgactaggcccggg

SEQ ID NO: 250 - DNA, 336 bp, Mycobacterium tuberculosis
  modified_base (308): a, t, c or g
tgacaacgcggcggcgattaccccgctaccgcagcagcatgacgcggtagcgaacaccgccggatgcagcgcaggtgcgtcgatgtgctcacggaatcgccccggcaccgcgatctcgaggatcaccagtgccaccccctgcagcgcgacaccgacgattccgtacaccgccacgccgatcaggccctgggccagctgattggagctggcgtatatggcggcgatggtgacgatggtcatcgcctcttacattgtggcggccagaaccacggcgttggggcggcggtcgatgaacactaggcgaccanatccccggggtcaacaggttgaccatcc

SEQ ID NO: 251 - DNA, 95 bp, Mycobacterium tuberculosis
cgcggacatcccgaacgaggacacgcgaccgcttcggtgtgtgatctatcagggctcgcaccacgcgcaaccgcttccggctacctagacgcggt

SEQ ID NO: 252 - DNA, 94 bp, Mycobacterium tuberculosis
  modified_base (78): a, t, c or g
gcatgcgggtgatgccgttctcagtgcgcaacagcgttcgacgcggcatacccagccgcacatgccgtgcacgccggngccggggcgggaatct

SEQ ID NO: 253 - DNA, 302 bp, Mycobacterium tuberculosis
  modified_base (13): a, t, c or g
  modified_base (16): a, t, c or g
  modified_base (158): a, t, c or g
ctcaagcttcagnccntctaagcggtctgcgcggcgatcgcaaagatcgccctttgccggcgttgggggcttctgctcgggggtgttgtacaccttctcgaacacctcggcaccgacaccaccaccgtcggcttgaacaccgccaacatcggcagcanatcttgatgtcctggtgaatccacggtgactttggagtggaaggcggccatactgatcgcgcgcgccaccacatgagctagcggcaggaaaaccagcagccgctcacccttgcgcagcagcgtcgggtgatatgcctggcgccc

SEQ ID NO: 254 - DNA, 291 bp, Mycobacterium tuberculosis
  modified_base (8): a, t, c or g
  modified_base (213): a, t, c or g
agtcgaangtcagtccggtctcctctccgactacggccaagaactggggcgacggtgtcagtgcagaacagcggaaactggtggcgccctaggcgagcgaacgctcacaaacggcggtgaccgcttctggtcgtgcaccatcgagccgtgcccagcccggccgcgtgccgtcagccgcatccactggatgcccttctcggcggtttcaatcangtacaggcgacgttcgccaccatcgtgccggggcacggttagcgagaaacgccgacttcaccgattgcctcggtgatg

SEQ ID NO: 255 - DNA, 454 bp, Mycobacterium tuberculosis
  modified_base (175): a, t, c or g
agcttcgcggcgtggcgatcgcggttcaaggcgcgctcttcgagcacaacgagcgaagacagctcggcgacggagcctttatcgacatccgttcgggctggctgaccggcggcgaagaactgctggacgcgttgttgtcgacggtgccgtggcgagccgagcgccgtcagatgtncgaccgggtggtcgatgtgccgcggctggtgagttttcacgacctgaccatcgaagatccgccgcatccgcagctggcgcggatgcgccggcggctcaacgacatctacggcggcgaactgggtgagcccttcaccaccgccgggctgtgctactaccgcgacggctctgacagcgtcgcctggcatggcgacaccattggtcgcggcagcactgaggacactatggtggcgatcgtcagcctcggcgccacccgcgtcttcgcgctgcggccgcgtgg

SEQ ID NO: 256 - DNA, 346 bp, Mycobacterium tuberculosis
  modified_base (77): a, t, c or g
  modified_base (338): a, t, c or g
agcttcagctgatactcgaccagccccactcgggccaatacgtgaatgtctagcatcttcacccgttcacgggctantcgagtagtagacattgattagcctgaacgtacctccgacgccagctgacgaacgggtatgacggatggatttcgtggtgtcgcgcccgaggtcaattcgttacggatgtatctcggggccggatcggggccgatgttggcggccgcggcggcctgggacggactatccgacgaactggcggtggcggcgtcgtggtttgggtcggtgacctcgggcctggcggatgcggcgtggcgcggcccgcggcggttgcgatggcncgcgcggt

SEQ ID NO: 257 - DNA, 339 bp, Mycobacterium tuberculosis
  modified_base (287): a, t, c or g
ctggtcatggacgttgctccggtagtggctcactgccgatcctcctcgttgagagtgccacctcagggttgggtagggttgggtactcgaaaccaagttacccaccagtaacaccgtcaaaatatatccgttgcataggtcaatgcaagttgatgtgagctacattgcaccaactaactaaccaaccggttgggttagcggtgatcctggccgtgtcggtcctctcacctgcggtgatagcgatcaaatgaagaatatgcggagtctagggcggcagcgcctggcancgtagatcatcggctcacgcggatgcggcctcttggtacggacatgcgcgcg

SEQ ID NO: 258 - DNA, 182 bp, Mycobacterium tuberculosis
  modified_base (78): a, t, c or g
ctcgtgagtagcacccctgtaatttgggatcggcaaaaaggcgaatcaccgcgtggccacgacacgccgggagggacnatctcgggcggctagggcttctcgcgggaaggcccgaacgtacggcgtttcaacacgtcgcgtcgccctccgaccgcgaacattcggggatggcagcaacctgg

SEQ ID NO: 259 - DNA, 213 bp, Mycobacterium tuberculosis
  modified_base (132): a, t, c or g
ggatcaactaccggccaacggtgattcttgggcgccgctgacgcgcgaacgacccagcgacacattcagcagatggccagcgcgtgccgggccacgatgttggtgctcggcggctactcccatggtgcggcncgtgatcgacatcgtcaccgccgcaccactgccggcctcgggttcacgcagccgttgccgcccgcagcggacgatcacatc

SEQ ID NO: 260 - DNA, 321 bp, Mycobacterium tuberculosis
  modified_base (257): a, t, c or g
aggaccgtcagcacggcgacgtgctactcgccgagcagtgggaatcgctctgcagcaaaccattactctgcgcgacgttcgagatgaccttctgaatggacggatctacctgccgcgcgacgacctggaccgcgtatgcgtccgcctccgcctggacgacaccggggcactctatgaccccgacggacggctcgcggtactgctgcggttcaccgccgacgcccgcacggtacgcgtcgggactgcgctgagtccancctcgacgccgtagcgctgctgctgtgcggccatgtctggcatctaccgccgtcgctcccttga

SEQ ID NO: 261 - DNA, 334 bp, Mycobacterium tuberculosis
  modified_base (311): a, t, c or g
  modified_base (316): a, t, c or g
cgactctgttggccactgcgggtcgatcttgcggccgccccggtcgtggaacgcccaggtcacccggcggcgcaccgcggtcagcgcgtcgttggccagcgtggtcacatggaagtggtcgacgacgagcttggcgttgggcagcagcccgggcgtgcggatcgccgaggcgtatgcagcggcggggtcgatggccaccgtactggatgctctcccggaactgcggtgtgcgcgcttgcagccatgccagcaccgccgcgccgccgcggccttcatgctgcccataaaccctgataccggccaggtcgacnaaccngtatcccacggtcaaccc

SEQ ID NO: 262 - DNA, 208 bp, Mycobacterium tuberculosis
  modified_base (208): a, t, c or g
cacacggacggcggtgcggacgcagctgacgcgcatggtggtcagcatcgcggccggtctgctgttgtatgcctacttcgcgccgcgcaaatgctggtgggcggcggtggtggcgctcgcatggctgggctgggtgctgacccaactctcgaaccacaccggtgggtgggctgggctatggcctgccatatcggcctggtgttctacn

SEQ ID NO: 263 - DNA, 233 bp, Mycobacterium tuberculosis
  modified_base (38): a, t, c or g
ccgatatccgagccgatagctggcgggctcgggtggtngccagcggcgctgcgacgaaagtgtgaccgtcatgaaacagacaccaccggcggccgtcggccgtcgtcacctgctcgagatctcagcatccgcagccggtgtgatcgcgctttcggcgtgtagtgggtcgccgcccgagcccggcaaacgccggcccgacacaaccccggaacaggaagtccggtcaccgcgcc

SEQ ID NO: 264 - DNA, 320 bp, Mycobacterium tuberculosis
  modified_base (17): a, t, c or g
  modified_base (249): a, t, c or g
gcttcaggacaaattgnatccctatgcacccgttgtcacgccgatgagtgaagactgcacgcaatcgccggaatccggcaaaaccctgcacaagcgaaatcaaccggaggctgacaaggcaacgtcggtgatccgtaccgcctggttggacaaacggcagaaggcgcctcgtccggtccatctacgccgagcacactggtgatagcgccatcggcatcggtgcggccacggtggagacgaacgtccgcnggcgtctgggtcagtaacccgccgaccagttctcgggcaagctggtcaacatcgggcgccacgtctccaac

SEQ ID NO: 265 - DNA, 304 bp, Mycobacterium tuberculosis
gtttggcggccttattgcactgaggtcgtcaattgacccacagcggaaatgccgactattcgcaggcctccttcgccttggctgccggagatgggctccgcgggaaccgcatgcaggtatatgacctcggtttctcgggtgctaccgcgtgccttgtcgaggatgaactcggcgttggaattgtccagccggcccaattcatcgagcgcagattcgtacacatggccggcggcgacataccttcaccgtggatctgctccacacggaccgccctgtcgggatctgctcacgggtaaaggaatta

SEQ ID NO: 266 - DNA, 217 bp, Mycobacterium tuberculosis
  modified_base (139)..(140): a, t, c or g
gcgcactcctccttatcgctccgctctgcatcgtcgcggcgcggtcaggtgcaaacgccttcgggggtgggggtcctgcggagcacaccggatacggagcgcaacgcgtcgcgttgtgcgggcaaacaagtgtgcaggnnccaatgccatgtccagcagcttatcagtgtcgaacgtgcgaacgtcgcgccttcgccggtgcctgaatctctacaag

SEQ ID NO: 267 - DNA, 174 bp, Mycobacterium tuberculosis
  modified_base (152): a, t, c or g
cgctgaaagccaccattcgcgggtcgggcgccgggctcgggccgccaggctgctccgctcggtgatggcacgccaccgcgacaccacccggctgcgctacgtcgagccataccgggcggagctacatcggctcggccgcctagtgttcgggncctctttcgaggtcgaggtcga

SEQ ID NO: 268 - DNA, 144 bp, Mycobacterium tuberculosis
  modified_base (28): a, t, c or g
tgtaatttgggatgggcaaaaagcaaancaccgcgtggccacaaacgcggggagggacaatctcgggcggctagggcttctcgcgggaagcccgaaacgtacggcgtttcaacacgtcgcgtcgcctccgacgcgaaattcggg

SEQ ID NO: 269 - DNA, 216 bp, Mycobacterium tuberculosis
cttgggcaacatgctgaggatcgccttttcaccacgcggtcggggtggcgttgcattagctcaccgatggtgcgcttgttgcaggccgccgggatacccgagtgccggtaaaccatcttgtgctgcagtttgtcccgctgatggcgaccttgtcgcgttgatcacgatgacgaagtcaccgccatcgacattgggggcgaactcggcttgtgcttg

SEQ ID NO: 270 - DNA, 199 bp, Mycobacterium tuberculosis
  modified_base (191): a, t, c or g
gcatgcttcattatctaatctccagccgtggtttaatcagacgatcgaaaattcatgcagacggtcccaaatagaaagacattctccaggcaccagttgaagaggttgatcaatggtctgttcaaaaacaagttctcatccggattgaactttaccaacttcatccgtttcatgtacaacatttttagaancatgcttc

SEQ ID NO: 271 - DNA, 230 bp, Mycobacterium tuberculosis
  modified_base (187): a, t, c or g
atactcaagcttgatgccgccgaaaccgagcgtgagcacgccgccagccaccacgcgcgggtcgggcgccgggcccgggccgccaggctgctccgctcggtgatggcacgccaccgcgacaccacccggctgcgctacgtctatccataccgggcggagctacatcggctcggccgcccattgttcnggccctctttcgaggtcgaggtctataccgatttgcgcatccg

SEQ ID NO: 272 - DNA, 188 bp, Mycobacterium tuberculosis
tccgtactggtcgggtacgcttcggtcgcagtgtgcgagtgatagatgacgaccgggacctcgtcggcatcttccatagcccgccacaccttcagttgctcaccggaatccaaccggtagaaggtcggcgagcgctcggcattggtcatcgggatatgccgctcgggacggtcagaacctcgggtccg

SEQ ID NO: 273 - DNA, 158 bp, Mycobacterium tuberculosis
  modified_base (127): a, t, c or g
gttctcgcacgatttcggattagcgggatggtctcaattgggtatgcggggaaggcgctgacattcgccgcgattagctgtttgatggaccgggggtgatttttgatcacggaaatgggtgtttatncaggtcgcacgctttcatccggggcggaacg

SEQ ID NO: 274 - DNA, 237 bp, Mycobacterium tuberculosis
  modified_base (83): a, t, c or g
  modified_base (181): a, t, c or g
gggtgtgcctgctgtgtatgcacggcatacggacatccttcccctgaagacccgcggtcgaacagccacgtgtccatcatcanggggtcaaccccggccaagggcgacggcacgccaagttcgccgaccgttaacctagtgctgttagcttcatttgctgcgagcaaaacagctggtcggncgttaggaatgaattgaaactcaaccgatttggtgccgccgtaggtgtcctggctg

SEQ ID NO: 275 - DNA, 262 bp, Mycobacterium tuberculosis
  modified_base (21): a, t, c or g
  modified_base (39): a, t, c or g
  modified_base (97): a, t, c or g
  modified_base (122): a, t, c or g
  modified_base (130): a, t, c or g
  modified_base (144): a, t, c or g
  modified_base (222)..(223): a, t, c or g
  modified_base (225): a, t, c or g
  modified_base (229): a, t, c or g
actacccggccaacggtgatntcttggccgccgctgacngcgcgaacgacgccagcgaccacattcagcagatggccagcgcgtgccgggccacgangttggtgctcggcggctactcccanggtgcggncgtgatcgacatcntcaccgccgcaccactgcccggcctcgggttcaccagccgttgccgcccgcagcggacgatcacatcgcttttatttnntnttcnggaatccctcgggccgcgctggcgggctgatga

SEQ ID NO: 276 - DNA, 222 bp, Mycobacterium tuberculosis
  modified_base (10): a, t, c or g
  modified_base (160): a, t, c or g
  modified_base (198): a, t, c or g
acgtcggganactgttcgcgttcatcctcgtctcggcggattggtctgctgcgccggaccgaccgatcttcagcggggggtcacgctccgtggggtgccgttacttccgatcgcccagtgtgcgcgtgctgtggctgatgctgaacctcaccgcgttganttggatcggttcgggatctggctggtggccggaacgcnatttatgtcgctacgggcgccggc

SEQ ID NO: 277 - DNA, 166 bp, Mycobacterium tuberculosis
gctcaaaggcactactggcaccaaggcccacacgtcacctgtgactcctgcgccgacccgcccgaggtctggccgttacaccgaacgggcgagccgggagttggtaccatcgaacaagacaaggtgcatgggcggagttgttccgccacttcgtcgatgacgggtc

SEQ ID NO: 278 - DNA, 330 bp, Mycobacterium tuberculosis
  modified_base (268): a, t, c or g
  modified_base (273): a, t, c or g
cgataccggctgcttaccgagacatccaccatgccacccgaatcaccgcacgcgccgaaatcgcacaacagcttgacgccttgcaggttccgcgattggaattgccgacggtctctgacggcgtcgaccttggcagcctctacgagctctcggaatcacttgcccagcagggggttcgatgagtgtcacaccgaagacctcgatatgggcgcaatcctggccgacacatccaaccgggtggttgtgtgctgcggcgccggtggggtcngcaanacactaccgcggccgcgctggcgttgcgcgcggccgaatatggccgcactgtggtcg

SEQ ID NO: 279 - DNA, 332 bp, Mycobacterium tuberculosis
  modified_base (169): a, t, c or g
  modified_base (213): a, t, c or g
  modified_base (227): a, t, c or g
  modified_base (230): a, t, c or g
cgtcgtcgtcgtggtatgcgatagccatcccgtcgggctactcgccatcaccgatcagcttcgccccgaagccgccgcggcgatttccgctgcgaccaaactgaccggggccaaaccggtattgcttaccggcgacaaccgggccaccgccgatcggctcggtgtacangttggcatcgacgacgtacgggccgggctactgccgacgacaangtcgcagccgtgcngcngctgcaagctggaggtgccagattgaccgtggtcggtgacggtatcaacgacctccggccttagcggccgcgcatgtcgcatcgccatgggcagcgcccgac

SEQ ID NO: 280 - DNA, 222 bp, Mycobacterium tuberculosis
  modified_base (43): a, t, c or g
  modified_base (54): a, t, c or g
  modified_base (203): a, t, c or g
gcacgcaatcgaagtcacccaaaccgggcgggccaggcgtctnacgccacgtcnaccagccgcaacctcaacccggccacggcgagctcctgatcaaggccgaggccatcggtgtctacttcatcgacacctacttccgctccgggcaatatccgcgcgaactcccgttcgtcatctgctccgaagtatgcggcacggtggangccgtcggccaggggttac

SEQ ID NO: 281 - DNA, 184 bp, Mycobacterium tuberculosis
  modified_base (140): a, t, c or g
  modified_base (143): a, t, c or g
  modified_base (172): a, t, c or g
tcgactgtgtggccacagatcacgccccgcatgccgagcacgagaaatgcgtcgaattcgccgcgggccggccggcatgctcgggttgcagacggcattgtcggtggtggtgcatacaatggtggcgccggcttgttganttnggcgcgatatcgcgcgggtgatgagtganaaccggcgtgca

SEQ ID NO: 282 - DNA, 409 bp, Mycobacterium tuberculosis
  modified_base (46): a, t, c or g
  modified_base (137): a, t, c or g
  modified_base (144): a, t, c or g
  modified_base (375): a, t, c or g
  modified_base (409): a, t, c or g
gaacctgacaccctggtcacgggtgagcacggacttgatttcttcnctattggtcggcgctgttgagcacaccacgccgctgacggccgtcgcgtcctcgctgtgctcggtctggtggagcgcgctgcccgcggccnaacatcntaaatcaagcgtattcgtcaacagatatcatcaatgtcggcgctggactattcaaatcatcgatatactggtgacctggtccttcgccatcgatcaatggcgatagtcacgcaaatcgtcacggacatcgtcggcgtcccagctggcccgtgccaacagatgctgcaacccatcggggtggtatcaccgcggtgctcggcgatggtccacaattcttgcggtccaagcccnaaacatcccgggcatgaattcaccggcatgcgcn

SEQ ID NO: 283 - DNA, 413 bp, Mycobacterium tuberculosis
  modified_base (77): a, t, c or g
  modified_base (322): a, t, c or g
ctatcgtacccgcgccggtcaccttctggatatcgccggcctggtcaagggggcgtccgagggagccgggctgggtnacaagttcctggctcatatccgcgaatgcgacgccatttgtcaggtggtgcgggtgttcgtcgacgacgacgtgactcatgtcaccggacgggtcgatccccagtccgacattgaggtcgtcgagaccgagctgatcctggcagatctgcaaaccctggagcgggccacgggccggctggagaatgaagcgcgcaccaacaaggcgcgcaagccggtctacgaagcggcactgcgtgcccagcangtgctcgacgccgggcaagacgctgttcgccgcgggggtggatgccgccgcgttgcgcgactgaaactgctgaccaccaagcccttcctgt

SEQ ID NO: 284 - DNA, 283 bp, Mycobacterium tuberculosis
  modified_base (216): a, t, c or g
tactcaagcttcaggccgccacgtccgccgtccgtcggcgacgtgacctcgagcgccgagttcgactcgacatcgccgccggcgcatgccgacatgaacgcggcactcaccgcaagcccgtcggacgtcaggtcgatcgactccgcttcaagcaccggatcgtccgggcaactcgcggcctcggcctgtgcgaacggcacacccgtcgtggcggcnccccgcgcggaactgggctcatcacggtcgttgcgagccggtcgcgtcaccgcgtaccgacgccgtc

SEQ ID NO: 285 - DNA, 397 bp, Mycobacterium tuberculosis
ccgacatcgagtgggctcgcagtgacttggcgacctccaagccaccggtacccgccgcgcggcaagccaaggacgacgacggccttgccggatagctgcgccaggcgttgcgccaactggcgtccagcgtcgccacgatcgtcaaagagcttcatctgccgagtgtgtcgccatctcatggctccaaatatggaattaggtccctgggccgactgacgacagtccctcagcgaccggattgcgcatcccgccttgtacgctactccgcaaatcccgggcttgcgtccgcggaagcgaactcggcggcgctacgtggtggttcacttcggccgtgcgcactcggatcgacgggccgatggtggccgggcccgcgcgcttcttggtcatccgattgagt

SEQ ID NO: 286 - DNA, 342 bp, Mycobacterium tuberculosis
atactcaagcttgtcgcggtaaaccgcacgcagggcggtgggtgcggtgtcaaagacacccacacttctttgcggttcggtgatctcgacaccggccgcgagccgaccaccatgcgcgcgtagatcggcgatcagcgcgtcggctatcgcctgggtgccgcccaccggaatcggccagccgaccgaatgggccagcgttgccagcatcagtccggcgccggccgacaccagtgacggcaacggtgaaatcgcgtgggcggcaacgccggtgaacaacgcgcgggcatcctcgcccgccaacgaccgccaggcagggtgcctgggccatcatccgcagcccga

SEQ ID NO: 287 - DNA, 430 bp, Mycobacterium tuberculosis
tggactcataacgatcgggtcagcgacgcgccaacacgaacggccggacgagtgggccagggtcgcgcctcccctacaaacaggatccgttgcctgcgagcgacaggctccggtgcggcgttgggcgccgtgctcgtcccagcgtccggtcccgggtcgccggcgacgcttgtttcctccatactcgccccctaatctcgaggcagcccgtacccgcaggcaacctcccaaaaatgcaatcccccaaaatgcaatgcgtcgagctatttctcacaccgaccgctagttgcggatcagaaatccgttgggcgcggaagtccagccgaatttgttctcccgctccgcatcatgcttgtaatcgtttggaaatcatcctcatatgcctcgatcgcttcataggtcaagcccaaacccggcaggatgggtggcc

SEQ ID NO: 288 - DNA, 473 bp, Mycobacterium tuberculosis
ctttacactttatgcttccggctcgtatgttgtgtggaattgtgagcggataacaatttcacacaggaaacagctatgaccatgattacgccaagctatttaggtgacactatagaatactcaagcttagtggttgcgcacgtaaattcgtcaggtgaccgatcccctgctgtctcactcgcctcacagcgaccaccacggctggcgctcaaggcgggcacgtgcggagcagatgaggaatgtgcgacgtcttgatgcagcctgtcagaacaccgagaccctcgacgaacttacgatcgaaaccgcttaggccaaccggtgacgggggtgtctttccgcggctagggcgccttatcgtccgaaggccgtgggtggtgatcgccttctgggtcgcgcttgcgggtctgcttgcgccgacggtgccgtccctggaccgatctcccagcggcatccagtggcgattctgccatcgg

SEQ ID NO: 289 - DNA, 418 bp, Mycobacterium tuberculosis
caggcatgcaagcttgcgatgtatcaacacgccgttgcgcagcgtgagccgatagttgacatccggctcggtgaaggtgaaatcgatggccaggtcgaggtcccatgcgcgtgggccattgatgctgatcgccaggacgtcaaagatttggtccggcgtcagctgggcgaaaaacgtgggcgccgggacttgcccggagctgcccgggttcccgtcgcgcagctcggcggccccggtcagaaagaaattgcgccaggtcgcacactccgcgccgtaggccagctgctccacggtgtcggcatatagcccgcgggccgcagcgtgctcgctgtcggcgaacaccgcatggtcgagaagcgttgccgcccaacggaaatcactgcgtcaaagcttcgccgggccactccagcactccgtc

SEQ ID NO: 290 - DNA, 194 bp, Mycobacterium tuberculosis
atactcaagcttgaccgacgctgatcgcaccgcacgcgggaacctcaagggcactactggcacaagggcccacacgtcaacctgttaactcctgcgccgaccccggccgaagtccttggcgttaacaccgaacgggccaacccgggaatttgggttccatcaaaacaaatagcaggtgcctgggcggagtgttc

SEQ ID NO: 291 - DNA, 166 bp, Mycobacterium tuberculosis
gtcgtcgtgtgctggggcgtccgtatcagcacgcccacgaaatggggcacaagaaggattcctggaacggtggctgtccaagatcaccctcgcccaaaactgctacgggcacttctacatcgagcacaaccgtggccatcacgtccgcggtgtccacaccgggagg

SEQ ID NO: 292 - DNA, 291 bp, Mycobacterium tuberculosis
  modified_base (288): a, t, c or g
atatgccttgctgagcttttcggatcgcagcgagtcgtacccgcgccggtcaccttcgtggatatcgccggcctggtcaagggggcgtccgagggagccgggctgggtaacaagttcctggctcatatccgcgaatgcgacgccatttgtcaggtggtgcgggtgttcgtcgacaacgacgtgactcatgtcaccggacgggtcgatccccagtccgacattgaggtcgtcgagaccgagctgatcctggcagatctgcaagccctggagcgggccacggggcggctngaa

SEQ ID NO: 293 - DNA, 442 bp, Mycobacterium tuberculosis
  modified_base (323): a, t, c or g
gacaccctggtcacgggtgagcaggactcgatttcttcgctattggtcggcgctgttgaggcacagcacgccgctgaggccgtcgcgtcctcgctgtgctcggtctggtggagcgcgctgcccgcggccgaacatcgtaaatcaagcgtattcgtcaacagatatcatcaatgtcggcgctggactattcaaatcatcgatatactggtgacctggtccttcgccatcgatcaatggcgatagtcacgcagatcgtcacggacatcgtctgcgtcccagctggcccgtgccaacagatgctgcaacccatcggggtggtatcnccgcggtgctcggcgatggtccaacaattcttgcggtccaagcccgaaaccatccggccatgagttcaccggcatggcgcaacggctggtgccgggcaaaacgcggcgcgatcgaattc

SEQ ID NO: 294 - DNA, 150 bp, Mycobacterium tuberculosis
tgtagaaggtgggtcccgtccaacttcgcggcggcggcgcgatatgccttgctggtcttgctcatttgatatccaatctatgggtcgtggttactcaacgggccgaagctggccctcccacgggtagggtcctattcgacggtgatgtcc

SEQ ID NO: 295 - DNA, 321 bp, Mycobacterium tuberculosis
cccgaatccggtggccggcagggggcctggcgacgtggacaccttctaacttgtctttaccggtcactgttgcaccccaacacctttaacgacgtggacggacgttacatcggattcgacggtgtcatccacagcgttgccattgggcacacccactacgccaatttctccgactgggacacctaccgcagcctcgccccactgcagggactgttgttcccgcaacgggccatcgacatgatccagtcgttggtgaccgacgcggagcagactggtgcgtatccgcgttgggcgctggcgaaattccgccaccggcatgat

SEQ ID NO: 296 - DNA, 184 bp, Mycobacterium tuberculosis
ttgagatgctggtcgggatgccgatggttggaacatggtcccctggcgtcgaatacgcgcgagcgcatgagctcaccggttcggaacaacgtatcgaagaactcgcactgctggcagatggtatctccgatgtggttgtaatttgtatcccaactctaactgtgctatcggatctgcgtgaata

SEQ ID NO: 297 - DNA, 259 bp, Mycobacterium tuberculosis
  modified_base (225): a, t, c or g
  modified_base (227): a, t, c or g
cgtaatcacgatcccgctgagacacttgaccttacggccgaagtgacttcgctgctgctatgccgacacccgatttccatacgctgctgtacacgacggccgggccggtggcctccatcacgctcaaccgcccggaacagctcaacaccatcgtcccgcccatgcccgacgagatcgaggccgctatcgggttggtcgaacgcgaccaggacatcaaggtcatcntnctgcgcggtggcgggcgcgccttctccggcgg

SEQ ID NO: 298 - DNA, 369 bp, Mycobacterium tuberculosis
  modified_base (296): a, t, c or g
  modified_base (324): a, t, c or g
  modified_base (334): a, t, c or g
caagcttaagctggttccggccactccatgagccgtagtgcaatggttcgtgcacggcgaggccgaacttgccataaacatccctgacgaaagtctccggcaagccgattgcttcttcgggccgcttcttgtggattgtccgataacccggtccctcatgctggaagttgtgcgcactctttccttccgcgatgtgggctaacgactcgtcattgagcaagaagtacgtgcacaggcatcgtccgccgggcttcagcacgcgggagatctcgtccagatagtgctccacgtccggngggaaacatgtgggtgaacaccgaggtnagaaacaccncatccaacgacgcatccgggatatggaaagcgaaa

SEQ ID NO: 299 - DNA, 387 bp, Mycobacterium tuberculosis
tatggtcttcgtcgaccagtacgtcgtaggcgccatgagccagcgactgaagccgcgccatgcctgcacggcccgctcatccagcgaggcggccatctcccgcagatagcctgccgcctcggcgcgcacgctgtccggatcgcgtccgagctcgtcggccagcgcacgcagccgctcgtcataccatcgggcatccagcagttgggtaacctcaacggggtcggtcgctagcggcgtcattgattcagcaacaataccgatgcgctgcagcaactttcgcagtccgatgcggcccacctcccgtgcagtcactggctagcccccgtcatgccggttgtgtcgatggcacggcagcgggctcgtaaacctgcggtctcagctcgctgg

SEQ ID NO: 300 - DNA, 73 bp, Mycobacterium tuberculosis
gcttagcggtcttgctcgaaccgacattgcgtgccactcatgagcgggtggcggtcgcggtgcttacacatct

SEQ ID NO: 301 - DNA, 156 bp, Mycobacterium tuberculosis
gtatctggcgcctctcgaatatccttgaacgtcccgcggtgccacccagatagatcgcagcgccctgcaatggagttccctttatggcctctctagcctcccgcttgatcggctcgacccgagagatgccctcgggcgttgcgggatctccctcca

SEQ ID NO: 302 - DNA, 394 bp, Mycobacterium tuberculosis
  modified_base (341): a, t, c or g
  modified_base (347): a, t, c or g
  modified_base (349): a, t, c or g
  modified_base (361): a, t, c or g
cttcacgccgatccgcgaccgcgaacgcgacggtgacggtgggcgacaaggttcggttggtcgccgcggcgctgggcgatatcagctcacccggtttcgaggtgttcggcgaccggacggtgctgcagacattcttgagcgtcctcgaccggcccgattcggccttcaacatcgtgacgccgtatttcggcggtaccgctcggcgccgagtcgaaggcggcctgagctaaagccgggcattgcgcgagtggtaaacaagttcggtgacttcggttgaccgactcgacgggctcgatctgggcgcgctggaccggtatctgcgttcgctggggatcgggccnaccgcnanttgcgttgcganctgattccggtggagctccaatctgacttccgg

SEQ ID NO: 303 - DNA, 404 bp, Mycobacterium tuberculosis
  modified_base (106): a, t, c or g
  modified_base (170): a, t, c or g
  modified_base (298): a, t, c or g
  modified_base (304): a, t, c or g
  modified_base (346): a, t, c or g
  modified_base (373): a, t, c or g
  modified_base (401): a, t, c or g
gcagctaccgaccctagcgacgagtgtgttcgcagcgtcgaatgtgaacgttcggcgtgattcggcgcgcgggttcccgctctcagcgcacgttcggcgccgaggnggctagtccctggttaagcaatgtctcggtcgccgccagcagcgcgcatgtcgccaacccgtcnaccgcgttgcgcatgtccggtaccgacggaaacgacggcgcgatccggatgttcttgtcgtccggatcctttcgatacgggaacgaccccccgcctcggtcaccgcgataccaacgtccttagccaangctacngtccggcgcgcggtcccgggcaacacgtcgaagctgatgaantaaccacccttgggctcggtccaagangcgatcttggactccttaaccgctgatncaa

SEQ ID NO: 304 - DNA, 479 bp, Mycobacterium tuberculosis
  modified_base (262): a, t, c or g
  modified_base (398): a, t, c or g
tccccatcggcgccggaccgtttgaaagtccaagcacgggtgggatggaatcgacgacagttgagcgccgtcggtggccgtggtcagcagctgttcgcgaacgcaccaggtcacatcccttcgacatctcaccgacgtggcacgggcgacatcaacaggaagattgacgaatccctcgcaggcgcggcacgtccgcaggccaacgccaactacggggccaccagcgatcctccgctcacgcaccagcccaagccaggctcanccacccaagtcggcccgcgctctccctcgccccctggtctccggggccttgttaaacaactaccggaagtccaccaatcctcgctgcatctcgacaccgtccgcctcactcccttcctcccgcccctctccacacnacacacctcttgcattaaggtcacggagcggtcacttttcgtcggacgaaattcgcaatccggccgctcgccgccagagat

SEQ ID NO: 305 - DNA, 260 bp, Mycobacterium tuberculosis
cggaaagtggatactcccagcaggtagcaggtcgccaccacgctggtcagtgcgcgttcagctcgcttgcggcgctgcagcagccagtccgggaaatagctgccctggcgcagcttggggatcgcgacgtcgatggttgcggcacgggtgtcgcaaatcacggtggcggtagccgttgcgctgattggaccgctcatcgctgcgttcgcggtagcccgccccgcacagggcgtcggcttcagcccccatcaaggcggcga

SEQ ID NO: 306 - DNA, 464 bp, Mycobacterium tuberculosis
  modified_base (38): a, t, c or g
  modified_base (102): a, t, c or g
  modified_base (270): a, t, c or g
  modified_base (383): a, t, c or g
  modified_base (456): a, t, c or g
ggccgagtccagcacttcgcactatgtgcagaccaaanacccggtggtcgccgcgctgcggcagcggctggcaacggcgccggtgatcaccgagtggtgcgnagttgccgaccggcagttcgccgcgggcttactacgagaagggcctgcgcgacgtcatcaggtatcacgtgtcgatgacgtcgagcgttaacttccccgaccagacggcgacctcgccgatggaccccgcgttgtacctggtgtgggcgcaagctaacgccgccgcangctatcggtactcggtcgaagcgcagccggggtcgcaagcgctagcgggcaaggtcgcgacgatctcggtcacctggaccaactacggcgctgctgccgccaccgaatagtgngtgcccggctaccggctggtggattccacgggacatgtggttcggacctgccggcagcggtggaactgaagangctggtct

SEQ ID NO: 307 - DNA, 315 bp, Mycobacterium tuberculosis
  modified_base (286): a, t, c or g
  modified_base (315): a, t, c or g
agcttcaaggacatcgtcatcgcgaccaaaaccgcgagctaggtcggcatccgggaagcatcgcgacaccgtggcgccgagcgccgctgccggcaggccgattaggcgggcagattagcccgccgcggctcccggctccgattacggcgccccgaatggcgtcaccggctggtaaccacgcttgcgcgcctgggcggcggcctgccggatcaggtggtatatgccgacaaagcctgcgtgatcggtcatcaccaacggtgacagcagccggttgtgcaccatcgcnaacgccaccccggtctccgggtctgtcan

SEQ ID NO: 308 - DNA, 331 bp, Mycobacterium tuberculosis
gctcgcggtccagcagcagacgtgtctgaccccgacgcccggccgccggtaccgaaaccggatcggcccgccgatggccgcggccacggcgtctgccttacccggcccggataccagcagccacacctcgcgggaacgctgaatcgccggcagggtcaaggtgattcggcgtggcggcggtttcgcgaatcgtccaccgccaccaccatgcgggtgctctcgaagacgcggggctgtgcgggaacagcgagttaatgtggccctcgggccccatgcccagcaggtggacgtcgaaattcggcccgggtcacctggtgcggcactggcggcc

SEQ ID NO: 309 - DNA, 286 bp, Mycobacterium tuberculosis
  modified_base (109): a, t, c or g
  modified_base (268): a, t, c or g
  modified_base (284): a, t, c or g
agcttgtcgatcgtccggcagcgtccggcgagtcaagtcgaagccagtccggtctcctctccgactacggccaagaactgggcgacggtgtcagtgcataccagcgganactggtggcgccctaggcgagcgaccgcctcacaaacggcggtgaccgcgttctggtcgtgcaccatcgagccgtgcccatcccggccgcgtgccgtcagccgcatccactggatgcccttctcggcggtttcaatcaggtacaggcgacgttcgccancatcgtgccggggcangg

SEQ ID NO: 310 - DNA, 331 bp, Mycobacterium tuberculosis
  modified_base (14): a, t, c or g
  modified_base (210): a, t, c or g
ttggtgatcatcgncccaacgaccccgaggcgatgttcttgcacaccgaggagtgtcgcaagctggggctggccttcgccgccgatccgtctcagcagctggcgaagctgtcggggtgaggaaattcgcaggctcgtcaacggtgctgcttacttgttcaccaacgactactaatgggatctgctgctgtccaagaccggctggtcagangccgatgtgatggcgcagatcgacctgcgggtgaccacattgggtcctaagggtgtcgatttggtagaacctgacgcaccaccatccacgtcggcgttggtccccgaaacagccagaccga

SEQ ID NO: 311 - DNA, 458 bp, Mycobacterium tuberculosis
ggctcgtatgttgtgtggaattgtgagcggataacaatttcacacaggaaacagctatgaccatgattacgccaagctatttaggtgacactatagaatactcaagcttgattttgatcatcatgatgatcatcacccgaagtgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcctggcggtgggatccgactacaatctgctgctgatttcccggttgaaagaggaaattggggccggattgaacaccggaattatccgtgccatggctggtaccgggggagtggtgacggctgccggcatggtgttcgccgttaccatgtcgttgtttgtgttcagcgatttgcgaatt

SEQ ID NO: 312 - DNA, 289 bp, Mycobacterium tuberculosis
  modified_base (277): a, t, c or g
caggcatgcaagcttggcgtgccgttccaacccgaattggctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcncccgggcgcacg

SEQ ID NO: 313 - DNA, 154 bp, Mycobacterium tuberculosis
ggcatcttggccgccatgttagccacactgccaccggctatagaagcgatgcgcaccgtcctgccagcacattgcggcgctcctccctggaaagcaagataaccaagctcatgccgtggttgtgggtggcgtggtttggtttgggtaactttgg

SEQ ID NO: 314 - DNA, 324 bp, Mycobacterium tuberculosis
tcggctaataatcgtcgacgccggcctcctctgcaatcgccttggcggtcgccgggttgtcaccggtgatcatcacggtgcggatgctcattcggcgcatttcgtcgaatcgttcccgtatgcccaccttgacgatgtccttcagatggacgacgccgatggcccgcgcgctgctgttatcggtccattccgcaacgactaggggtgtcccccgccggagctgatgccgtcgacaatggcacccacctcctcggtggggtgggcaccgtgatcgcgaacccacttcatcaccgcagccgcggcaccttgcggattcgacggatg

SEQ ID NO: 315 - DNA, 322 bp, Mycobacterium tuberculosis
  modified_base (65): a, t, c or g
  modified_base (91): a, t, c or g
  modified_base (117): a, t, c or g
  modified_base (303): a, t, c or g
  modified_base (312): a, t, c or g
ctcaagcttggaggcgtggcgatcgcggtccaaggcgcgctctccgagcacaacgagcgaagacngctcggcgacggagcctttatcgacntccgttcgggctggctgacggcggcnaaataatgctggactcgttgttgtcgacggtgccgtggcgagccgagcgccgtcagatgtacgaccgggtggtctatgtgccgcggttggtgagtttccacgacctgaccatcgaagatccgccgcatccgctgctggcgcggatgcgccggtggctcaactaattctacggcggcgaactgggtnatcccttcnccaccgtcgg

SEQ ID NO: 316 - DNA, 404 bp, Mycobacterium tuberculosis
cctaggtcaaccgtaccgtcatcggatcggggtcgaccgcacagatggactggagcttcggcgaggtcatcgcctatgcctcgcggggggtgacgctgaccccgggtgacgtgttcggctcgggcacggtgcccacctgcacgctcgtcgaagcacctcaggccaccggaaatcattcccgggctggctgcacgactgcgacgtggtcaccctccaggtcgaagggctgggcgagacgatgcagaccgtccggacgagcggcactccttttccgttggctcttcggccgaatccggacgccgaacccgaccggcgcggggtcaacccggcaccgacgcgggtgccgtttacccgcgggctgcacaaatcccgacgggtatgggctttgacctgccgacggggga

SEQ ID NO: 317 - DNA, 346 bp, Mycobacterium tuberculosis
agcttggcgtgacaccaacacagggcacttaagatggcaatgcgccgcctacctgcacgttttcgcgatgtcagaggatgccgaggggagaacaatgcgagcacggccgctgacgttgctcaccgctttggcggcggtgacattggtggtggttgcgggctgcgaggcccgagtctaggccgaagcatatagcgcggccgaccgcatttcgtctcgaccgcaagcgcgacctcagccgcagccggtggagctactgctgcgcgccatcacgccgcctagggctccggcggcgtcgccgaacgtcgggtttggcgaactgcctacccgggtccggcaggcaaccgat

SEQ ID NO: 318 - DNA, 333 bp, Mycobacterium tuberculosis
tcatgccgttggaccgaccatcggagttagttgccgaaccgcgggaccaccgcaagcacccggtcctggtcgcgcaccgcgtcggccaaccgcttgagcaccaccacgccgcagccctcgccgcgcacgaatccatccgcgttggcgtcgaagctgttgcatcggccggtcggtgacagcgccgaccacttggacagcgcgatggcggtgaacggtgacaaggtgagctgcaccccgcccgccaatgccacgtcggtttcacgcaggcgaagctctgacacgccaagtgaattgccaccagcgacgacgaacaagcggtatctacggcgatgg

SEQ ID NO: 319 - DNA, 207 bp, Mycobacterium tuberculosis
gggtcgactttctgcaaggcgaggctacaccgtcgtcgtcgtggtatgcgatagccatcccgtcgggctactcgccatcaccgatcagcttcgccccgaagccgccgtggtgatttccgctgcgaccaaactgaacggggccaaaccggtattgcttaccggcgacaaccgggccaccgccgatcggctcggtgttcaggttggcat

SEQ ID NO: 320 - DNA, 250 bp, Mycobacterium tuberculosis
aatccgaaatcctgaccgatacttgaacctggtctcgttcggcaataactcgtcggcgtgcaggacgcggcgcaaacgtacttcggcatcaacgcgtccgacctgaattggcagcaagcggcgctgctggccggcatggtgcaatctaacagcacgctcttcccgtacaccaaccccgacggcgcgctggcccgggcggaacgtggtcctcgacaccatgatcgaaaaaccttcccggggaggcggatgc

SEQ ID NO: 321 - DNA, 365 bp, Mycobacterium tuberculosis
  modified_base (18): a, t, c or g
ttccgaatttcgggtccnggtcatatgaccctcatggaagaagaagcggccgccccgcgcccgtgcgacggcgaatgaaaaccctcacccaggccgcattgaacgccgacaagacggtggagcaggtcgaagacgtcctggacggtctgggtaagaccatggccgagctgaacagctcgctgtcacagctgaacagcaccgtggagcgcttggaggacggtctggaccatctcgaaggtaccctgcacagcctggacgatctcgcgaaacggctcatcgtgttggtcgagccggtggaagccatcgtcgatcggatcgactacatcgtgagcctcggcgaaacggtgatgtcaccgctgtcggtc

SEQ ID NO: 322 - DNA, 413 bp, Mycobacterium tuberculosis
  modified_base (1): a, t, c or g
nctcgatcttggggtacgttcgatgaggctgctgaccaacaacccggccaagcgggtgggactggatggatacggattgcacatcatcgagcgcgtgccgctgccggtgcgggccaacgcggaagaacatccgttacctgatgaccaagcgtgacaaattggggcacgacttggctgggttggacgattttcacgaatccgtgcatctgcccggagaattcggcggtgccttgtgaaggtggcgccggggtgccggatctgccgtcgctggatcgtctggtgtgcggctggcgattgtcgccagcagctggcacggaaagatctgcgacgcgctgttggacggcgcccgcaagtggccgccgggtgtggcctcgatgaccgactgtggttcgggtgctccgcgcgatcgatat

SEQ ID NO: 323 - DNA, 364 bp, Mycobacterium tuberculosis
  modified_base (208): a, t, c or g
tcatcccgaccaaaacgcgagctaggtcggcatccgggaagcatcgcgacaccgtggcgccgagcgcgctgccggcaggccgattaggcgggcatattatcccgccgcggctcccggctccgagtacggcgccccgaatggcgtcaccggctggtaaccgctcttgcgcgcctgggcggcggcctgccggatcaggtggtagatgccnacaaagcctgcgtgatcggtcatcaccaacggtgacagcagccggttgtgcaccaagcgcgaacgccaccccggtctccgggtctgtccaaccgatcgaccgcccaagcccacatgaacaaaccccggcatcacgttgccgatcggcataccgtga

SEQ ID NO: 324 - DNA, 488 bp, Mycobacterium tuberculosis
  modified_base (312): a, t, c or g
  modified_base (425): a, t, c or g
  modified_base (449): a, t, c or g
ttggcgggttggcccagcagcccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtcgagcgccgttacctacgtgacctgatggatcggggggtgccgaccgtgcccggcgatgtgtatgtgccggganagccggtccggttgccacgcaaaggccatgtcttcgtcggtccgaccatcggtaccgggacacggcgctgtattgcccggttcgctgccgagttcgtcgcgcaactgcacgcnggcgggccagcggtgctcgttcancccggaggttccggtgacgatgatcgtgttggtctccct

SEQ ID NO: 325 - DNA, 396 bp, Mycobacterium tuberculosis
  modified_base (380): a, t, c or g
gtaggagagaacaaagaccgtcgataggacacgtgttacgccggtagctgtcattggtatggggtgccgctgccggggggcatctactcacccgatcggttgtgggaggcgttgctgcggggcgacaatctggtcaccgagatccccgccgaccgctgggacatctacgagtactacgaccccgaacccggcgtgcccggacgcaccgactgcaaatggggcgcgtacctcgataacgtcggcgactttgatcccgagttcttcgggatcggggagaaagaaacgatagcgatcgatccgcagcaccgcttgttgctggaaacctcctgggaagccatggaacacggcgggctaacaccgaaccatatgcctcccgacangggttttcgtggggtt

SEQ ID NO: 326 - DNA, 394 bp, Mycobacterium tuberculosis
cgaactgagcccatagaaaggcagcgactaattcgctgggcaaataggaagaccctttgtcctgccacgtatatttgtcgacctcgttgcgaaggaagcggctgcgattggtgcccttttccctggagaatctctgcccggagcaggaagtcttatgagttgacaagcaggggcgccgccttcgccggaaatcacattcttggtctcgtgaaatgagagcgctcccaggtcgccgatgctgccgagcgcccgcccacgatacgacgccatcgcgccttgggccgcgtcttcgaccaccgccaggttgtggtgcgtggcgatcttcatgatcgcgtccatctcgcaggccacccggcatagtgaacggggaccatggcctcggttcgcgggtgaa

SEQ ID NO: 327 - DNA, 140 bp, Mycobacterium tuberculosis
cttagacgccacctccgggccgagctccacggggtggataagtacggccggatgtggccgcaatgggaagttgttgcccgcttgactgtccgggttaacgccggattccaccacatccccttgcgaaaggccgttgggtt

SEQ ID NO: 328 - DNA, 242 bp, Mycobacterium tuberculosis
gatcgcgatcgtcgatgtggccatccggcttggcgtcgacccgcgtaaggcagaccagatggttcgcggcacggtcaacctgccacacgcactggtaagactgcccgcgtcgcggtattcgcggttggtgaaaaggccgatgctgccgttgccgcgggggctgatgctgtcggatcgacgatctgatcgagaggatcagggcggctggctggaattcgatgccgcgatcgcgataccggatt

SEQ ID NO: 329 - DNA, 220 bp, Mycobacterium tuberculosis
  modified_base (22): a, t, c or g
agcttacgccgctttcgcttcngatttgggacgccgcatcgaaagcgcagttggaagcgcggcgcccggctggtcgagctgctcaagcagccgcaatcccagcccatgcccgttgaggagcaagtggtttcgatcttcctgggcaccggcggtcacctggactcggtgcccgtcaaggatgtcggcggttcgaaaccgaattactggaccacatgcgggc

SEQ ID NO: 330 - DNA, 328 bp, Mycobacterium tuberculosis
  modified_base (140): a, t, c or g
  modified_base (228): a, t, c or g
cgacgggacctcgtcgcatcttccatagcccgccacaccttcagttgctcaccggaatccaaccggtataaggtcggcgaagcgctcggcattggtcatcgggatatgccgctcgggacggtcagatgccctcgggtccngccagcactcctcaggcttcgtcggggtggtcgcgaccgcatgggccacatcgcattcaccaggtctgcgcgaatcaccagcacgtanacggttcctttcctaagcaacaccgaaatttcaggacccgaatgctccgggaaaacatgtcacggtaagtccggtattccgggtaccggttgagcattga

SEQ ID NO: 331 - DNA, 366 bp, Mycobacterium tuberculosis
  modified_base (134): a, t, c or g
  modified_base (171): a, t, c or g
  modified_base (231): a, t, c or g
cggcatcggtttgggctgtcaccagcagttggtagttcttcactactgttgttcgagcgtcgagccgccgcgcgtgtcgaggtcgccggacgcgtacccgccaggccggtcagggtgcccttccagtccacgcngctgtggtcggctaaccgcttatcttcaatcgagacnatcgccagcttcatcgtgttggcgatcttgtccgagggcacctcgaaccggcgctgcgantacagccacgcgatcgtgttgcccttcgcgtcgaccatcgtcgataccgcaggcacttgcccctcgagcagctgggccgatccgttggcaacgacctcagaggcacgattggacatcagccctagcccgcctgcg

SEQ ID NO: 332 - DNA, 407 bp, Mycobacterium tuberculosis
  modified_base (8): a, t, c or g
ccgtcgangccgccgacttggcttgaccgacaccaacatggcctgagggtgttcaacaagaccgtggccgacgggctgaacatcaccatgagcggcatgagccacgccaccgagttcatcatgttgatcgccgaaaaccattggcgggtagcggaagaacggtcgaggtgctctacaccgagtattcgaagtcgaaaggccaaccgctgctcaacggcgtcaacatcattttcgacgggtttctgcgagggaggatgccacgatgaactggatccaggtgctgttgatcgcgtcgatcatcgggttgctgttctacctgttgcggtcgcgccgaagcgcgcggtccgtgcctgggtcaaggtgggctatgtcttgttcgtgctcccggcatctatgccgtgctgaga

SEQ ID NO: 333 - DNA, 473 bp, Mycobacterium tuberculosis
  modified_base (8): a, t, c or g
  modified_base (187): a, t, c or g
  modified_base (244): a, t, c or g
  modified_base (282): a, t, c or g
  modified_base (292): a, t, c or g
  modified_base (312): a, t, c or g
  modified_base (410): a, t, c or g
  modified_base (434): a, t, c or g
ttacacgncctgcttccggctcgtatgttgtgtggaattgtgagcggataacaatttcacacaggaaacagctatgaccatgattacgccaagctatttaggtgacactatagaatactcaagctttttgagcgtcgcgcggggcagcttcgccggcaattctactagcgagaagtctggcccgatncggatctgaccgaagtcgctgcggtgcagcccaccctcattggcgatggcgccgacnatggcgcctggaccgatcttgtgccgcttgccgacggngacgcggtangtggtcaagtccggtctacncttgggcctttgcggacggtcccgacgctggtcgcggttgcgccgcggaaagcggcgggtcgggtgccatcaggaatgcctcaccgccgcggcactgnacggccagtgccgcggcgatgtcngccatcgggacatcatgctcgcgttcatactcctcgacc

SEQ ID NO: 334 - DNA, 305 bp, Mycobacterium tuberculosis
caggcatgcaagctttgtcacaccaagtgtttcgaccaggcgctccatccggcgagtggatactcccagcaggtagcaggtcgccaccacgctggtcagtgcgcgttcagctcgcttgcggcgctgcagcagccagtccgggaaatagctgccctggcgcagcttggggatcgcgacgtcgatggttgcggcacgggtgtcgaaatcacggtggcggtagccgttgcgctgattggaccgctcatcgctgcgttcgcggtagcccgccccgcacagggcgtcggcttcagcccccatcaaggcgg

SEQ ID NO: 335 - DNA, 432 bp, Mycobacterium tuberculosis
  modified_base (401): a, t, c or g
agcttagccagtttttctactcttgggcccacacccacagtgcttcgacggtacggtcacccatgatggccatccagttggcatcggtgagctgataaatgccagctggtttcgccaacccggtagcgatcttggcgcgctgcttgttgtcactgatacctatcgagcaagacagcccggtttgcgacaagatgacttttcggatctcttcggcgacttcgatggggtcgtcgggagtcccgggcgccaccgcgaggtaagcctcgtcccagccccatacctcgaccgggtatcccaggtcgcgcaataacgccaccacctcctcggacgccgcgttgtaggcggctgggttcgacggcaagaagtggcctcagggcatcgtcggcgcggtcccaacggcntgccggcgcgcacaccgtaggcgcggggctc

SEQ ID NO: 336 - DNA, 429 bp, Mycobacterium tuberculosis
ccggcggaactcagacgtgctggtggtgcggcatggcaccgcgggcagcaaagcgcacttctccggggacgacagcaagcgaccgctagacaagaggggtcgtgcgcaggcagaagcgttggtaccacagctgctggcgttcggcgccaccgatgtttatgccgccgaccgggtgcgctgccaccagacgatggagccactcgccgcggaactgaacgtgaccatacacaacgagcccaccctgaccgaagagtcctacgccaacaaccccaaacgcggccgacaccgagtgctgcagatcgtcgagcaagtaggcacacccgtgatctgcacgcagggcaaggtcattcccgatctgatcacgtggtggtgcgagcgcgaccgtgtgcccccgacagtcccgcaatcgcaaaggcagcacgttggtgt

SEQ ID NO: 337 - DNA, 94 bp, Mycobacterium tuberculosis
gtatggtcagctgtccatccggcgctgtcggccgagctgccagatctcgtcagccgtaaccgggttgcgggatccacgcgtgcgggttgtctac

SEQ ID NO: 338 - DNA, 351 bp, Mycobacterium tuberculosis
  modified_base (336): a, t, c or g
  modified_base (342): a, t, c or g
ccgactttccgcgggtacccgctcaactttgtgtcnacctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacgcgacccggcctatggttattcgacctcgccgcccaatgttgcgactccgttcggttgttccagaangtcagcccg

SEQ ID NO: 339 - DNA, 152 bp, Mycobacterium tuberculosis
gcaccgatgtcggcgagcacttcgtcaacttccaggggtgcccgcaccaagtatttcgacgagtatttccgtcgggccgccgccgccggtgcgcggcaggtggtcatcctggcggcggggctgggactcgcgcgcgtaccggctgcctcggc

SEQ ID NO: 340 - DNA, 263 bp, Mycobacterium tuberculosis
tgcacccaacttactgagcatgctaacgctggtcgtgcgggtcttgttcccgcgtgtcggcagggcacacgctcggggcgtagctgggagaggccccggtcaagcccggagagcagtgctcagtccgccagcttgaccgactttcgatgagaacgcgcttctcgccgtattgaactggcgtgctgacggtcgctgagcagcgctcgccgagtgcggccgctgattctttcatcgagccaggacgcgcattcgtgttcggccgc

SEQ ID NO: 341 - DNA, 249 bp, Mycobacterium tuberculosis
  modified_base (218): a, t, c or g
  modified_base (236): a, t, c or g
agcttacggccggtcgacgcgacgagtggttcatgacaccacaaaccgtcaacgcctactacaacccggggatgaacgaaatcgtcttcccgcagcgattttacagccaccatttttcgatccgcaggccgacgaggccgccaactacggcgggatcggggcgcgtgatcgggcacgatgatcgggcacggtttcgacgatagggcgccaaatacganggcgacgcaatctggtcnattggtggatcga

SEQ ID NO: 342 - DNA, 269 bp, Mycobacterium tuberculosis
atgtcgtcacgtcaccacaatcgcgaggacccaatcatgccgcccagggcggccaacccaatggtggccgcgaagcggcagctcgatcgcagcgcggaggtgccggccgccagttgattcacgaacagggtgaggtcataggcgggcaggatagtgacgaacgcaagacctatatctgccgtcggagtaagaatcgagtagccggtcgaccaacggaagcgaaagtgtccgcgatgttgatgagcgtcgccggttgtggcggcggtggc

SEQ ID NO: 343 - DNA, 336 bp, Mycobacterium tuberculosis
  modified_base (30): a, t, c or g
agcttcaccagcgtgccgatgctgttcgcnacacctccctactatgcgcaattcgccgacacgggtggcatcaacacgggcgataaggtggacatcgctggggtgaacgtcgggctggtgcgctcgctggcaatccgcggcaaccgcgtgttgatcggattctcgttgcccggcaagacaatcgggatgcaaagccgggcagcaattcgcaccgacaccattcttggccgtaagaacctggaaatcgaaccccgcggttcggagccgttgaaacccaacggtttcctgccgttggcgcagaacactacgccataccaaatctatgacgcgttcgtc

SEQ ID NO: 344 - DNA, 417 bp, Mycobacterium tuberculosis
ctgccgcggtggcggtcagcgcctggcaagtcaccgcaccgccgtccggttcatcggcaggctcccccgaaaagggccctggcaacagaaggtgatcaatgagctcccgcagaccttcgccgatctgggaccgacatacgtgaagttcggccagatcatcgcgtccagcccgggagcattcggtgagtcgctgtcgcggggaattccgcggcctgctcgaccgggtgccgcccgcaaaaaccgacgaggtgcacaagctcttcgtcgaggaactcggcgacgagccggcccggctgttcgcctccttcgaggaagaaccgttcgcgtctgcgtccatcgcccaagtgcactacgcgacctgcgcagcggcgaagaagtgtggtcaagatccacggccgggcatccgccgccgcgttt

SEQ ID NO: 345 - DNA, 405 bp, Mycobacterium tuberculosis
  modified_base (334): a, t, c or g
  modified_base (360): a, t, c or g
gatcgtgccggccccccggcggcagtagcagatcagctcgtcgaaatcgcggcaaccagtccagtcgatttccatacgggcgccgtcaatcaactctgcgaacatcgcgatcggcaccggaaaccggcgagccgcgtcagccagcgcaaccagcaccgggatcggatgaatcatcaatattatcaagtgatttcctgatggcatcgagctcggtgatcttggtctcgggggccagctcgccgtcggcgacgtcgtcgatccggcggccgagcgcatagaccgcaaatagtgccgctcgcttttcgcgcggcaagagtcggatgccgtaatatangtttctggcggccgtgcgcgtgatcnactcggtgattcgatacgcctgttcatctcggtcatgccgtcctc

SEQ ID NO: 346 - DNA, 414 bp, Mycobacterium tuberculosis
  modified_base (340): a, t, c or g
  modified_base (373): a, t, c or g
ggtggcgcaatgaccgaaaccaccccagccccgcaaaccccggcggccccggccgggcccgcacaatcgttcgtgttggagcggcccatccagaccgttgggcgccgtaaggaggccgtggtacgagtgcggctggtgcccggcaccggcaagttcgacctcaacggccgcagcttggaggactacttcccaaacaaggtgcaccagcagttgatcaaggcacccctggtcaccgtggatcgggtggaaagtttcgacatctttgcccacctgggcggcggcggcccgtcgggtcatggccggcgcgctgcgcctgggtatcgcccgggcattgattctngtatcgccggatgaccggcccgcgctgaataangccggcttcttgaccgtgatccacgcgccaccgaacgcaaa

SEQ ID NO: 347 - DNA, 331 bp, Mycobacterium tuberculosis
cacaatagattactcaagcttcgaaccagcggccttatcacgtatccccgctgagaccttgacccttagggccgaagtgacttcgctgctgctatgccgacacccgatttccagacgctgctgttacacgacggccgggccggtggccaccatcacgctcaaccgcccggaacagctcaacaccatcgtcccgcccatgcccgacgagatcgaggccgctatcgggttggccgagcgcgaccaggacatcaaggtcatcgtgctgcgcggtgccggccgcgccttctccggcggttacaacttcggcggcgggttccaacattgggggcat

SEQ ID NO: 348 - DNA, 386 bp, Mycobacterium tuberculosis
tcaggacgcttatggttggcagatggtcgccctggcgtcgaatacgcgcgagcgcatgagctcaccggttcggaacaacgtatcgaagaacgtcgcactgctggcagatggtatctccgatgtggttgtaatttgtatcccaactctaactgtgctatcggatcagcgtgaatatcgagatattgcgaatgcgatgacaggccgccattcggtttattcgcttacgcttcccgggttcgattcgtctgatgcactgccgcaaaacgcggatatgattgttgaaaccgtatctaacgcaattattgatgtggtaggcggcagctgccgttttgtgctgtcgggctattcatcgggtgggggtgtttggctatgccctctgctcccat

SEQ ID NO: 349 - DNA, 187 bp, Mycobacterium tuberculosis
cgcagctgtcgccgatctggtccggaatacctagctccaggttctgagtggagatgagtgcggccatcgaagtgttgtcaatgtactccaggatgtcaggtgccaggccgctggcgaggatcttgggcaccgccgccatgacttggtcgaagtcggcgaacggggcgagcacgctggcgtcgtggtc

SEQ ID NO: 350 - DNA, 241 bp, Mycobacterium tuberculosis
gtagttcgttcatccaaacacagtgcggtaccggctcaagcggatcaccgacttcaccgggcgcgatcccacccagccacgcgatgcctatgtccttcgggtggcggccaccgtgggtcaactcaactatccgacgccgcactgaagcatcgacagcaatgccgtgtcatagattccctcgccggtcagagggggtccagcaggggccccggaaaagataccaggggcgccgtcggaccga

SEQ ID NO: 351 - DNA, 335 bp, Mycobacterium tuberculosis
  modified_base (296): a, t, c or g
tccgctcgcttctccgagaggttgagtgccaacgctctgccgatgcccgaagccggccccggtgatgacggcgaccttgccttcgaatgagctcatttgactactccccgtggttgtccctgcgattggtggaggtggccgcgcagccttgccccgaggtcggcgatcgcgtctcgggcttcggggagcagactgacctgcagatggaagtcgtgccacatgcccgcgaaccggcgatgctcgatgcttgttttcgaagcggcgcaggcggtttcgatcttgtccgcgtcaacacngatcggatcgtcgcccgcggtctgcatgacgaatgggcg

SEQ ID NO: 352 - DNA, 441 bp, Mycobacterium tuberculosis
  modified_base (425): a, t, c or g
atgggaggccaccgattaccatcttgcacacaccgattccgggctattgatgtccacgttcggtccgcgaaccgcgctgtggctgctgctggccaaaggcggaggcgataccgaagtcagtgcccaagcttgggttccacgctcgcgcagccacgccgtcacctttccacgagacctcacctgccgatccgaaatggaatcggccgtgacggaattggcgcagcgaacactcaacgaggtggtggcttcgtcgcgaaccgtcacccgagtcgcggtcaccgtgcgcacggcgacgttctacacccgcaccaagatccgaaagctgcaagctcccagcaccgatcccgacgtcatcaccgctgccgcccggcacgttcttgaacctattcgagctggaatcggccgtccggttgctgggaattgcngttaagaactgggcct

SEQ ID NO: 353 - DNA, 332 bp, Mycobacterium tuberculosis
gctttgcgcgcttctccgagaggttggagtgccaacgctctgccgatgcccgagccggccccggtgatgacggcgaccttgccttcgaatgagctcatttgactactccccgtggttgtccctgcgattggtggaggtggccgcgcagccttgccccgaggtcggcgatcgcgtcgcgggcttcggggagcaaactgacctgcagatggaagtcgtgccacatgcccgcgaaccggcgatgctcgatgcttgttttcgaagcggcgcaggcggttcgatcttgtccgcgtcaacgcagatcggatcgtcgcccgcgggtctgcatgaagaat

SEQ ID NO: 354 - DNA, 334 bp, Mycobacterium tuberculosis
  modified_base (334): a, t, c or g
ctcacgcagccacgccgtcacctttccacgaagacctcacctgccgatccgaaatggaatcggccgtgacggaaattggcgcagcgaaacactcaacgaggtggtggcttcgtcgcgaaccgtcacccgagtcgcggtcaccgtgcgcacggcgacgttctacacccgcaccaacatccgaaagctgcaagctcccagcaccgatcccgacgtcatcaccgctgccgcccggcacgttcttgacctattcgagctggatcggcccgtccggttgctgggagtgcggttagaaactggcctagaaaccggcgggcacaccgcacctgggcggggn

SEQ ID NO: 355 - DNA, 341 bp, Mycobacterium tuberculosis
  modified_base (159): a, t, c or g
  modified_base (190): a, t, c or g
  modified_base (335): a, t, c or g
tgcttccggctcgtatgttgtgtggaattgtgagcggataacaatttcacacaggaaacagctatgaccatgattacgccaagctatttaggtgacactatagaatactcaagcttgatgccgccgaaaccgagcgtgagcacgccgccagccaccacncgcgggtcgggcgccgggcccgggtcgccangctgctccgctcggtgatggcacgccaccgcgacaccacccggctgcgctacgtcgagccataccgggcggagctacatcggctcggccgcccagtgttcgggccctctttcgaagtcgaagtcgataccgattgcgcatccgcngccgca

SEQ ID NO: 356 - DNA, 259 bp, Mycobacterium tuberculosis
caggcatgcaagcttcacgtccgtacggctcgggtacgcttcggtcgcagtgtgcgagtgatagatgacgaccgggacctcgtctgcatcttccatagcccgccacaccttcagttgctcaccggaatccaaccggtagaaggtcggcgagcgctcggcattggtcatcgggatatgccgctcgggacggtcagaaccctcgggtccggccagcactccgcaggcttcgtcggggtggtcgcgacgcgcatgggccacc

SEQ ID NO: 357 - DNA, 349 bp, Mycobacterium tuberculosis
gcttgtctatcgtcccggccaggtccggccagtcaaggtcgaaggccagtccggtctcctctccgactacggccaagaactgggcgacggtgtcagtgcagaccagcggaaactggtggcgccctaggcgagcgaccgcctcacaaacggcggtgaccgcgttctggtcgtgcaccatcgagccgtgcccagcccggccgcgtgccgtcagccgcatccactggatgcccttctcggcggtttcaatcaggtacaggcgacgttcgccaccatcgtgccggggcacggttagcgagaaaccgccgacttcacgattgcctcggtgatgccgtcgaaacagatcgggcct

SEQ ID NO: 358 - DNA, 325 bp, Mycobacterium tuberculosis
gcgcgccatgttgaggttgtccgacggtgacgacggtgaaccacaactgtttgacctgtccgcacacaccgtgtggatcggcgagcggacccgacaaatcgatggcgcgcacatcgcgtttgcccaggtgattgctaatccggtcggggtcaagttgggccccaacatgaccccggaactggccgtggagtacgtcgagcggctcgacccgcacaataagccgggccggctgacttggtgagcaggatgggcaaccacaaggtccgcgatctgttgccaccgatcgtggagaacgtccatgccaccgggcatcaggtcatctggc

SEQ ID NO: 359 - DNA, 191 bp, Mycobacterium tuberculosis
ttgccttccatgccgagcaaggtcgactcagcgatgacgaattgttcttcttcgcgggtgttgctgctggttgcgggctatgagagcactgctcatatgattagcacattgtttctgacgctggccgactatccagatcagctgacactccttgcgcagcaaccagacctgatcccgccggcgatcgagga

SEQ ID NO: 360 - DNA, 74 bp, Mycobacterium tuberculosis
cgacgctgggcccaactgcgaccaccaggtcctggtatggcaggacatggccgggttcagcggcgccaataccg

SEQ ID NO: 361 - DNA, 312 bp, Mycobacterium tuberculosis
  modified_base (33): a, t, c or g
  modified_base (45): a, t, c or g
  modified_base (258): a, t, c or g
  modified_base (294): a, t, c or g
taacgactcgggtccagcgaccgcgccaacacnaacggccggacnacgtgggccagggtcgcggcctcccctacaaacaggatccgttgcctgcgaacgacaggctccggtgcggcgttgggcgccgtgctcgtcccagcgtccggtcccgggtcgccggcgacgcttgtttcctccatactcgccccctaatctcgaggcagcccgtacccgcaggcaacctcccaaaaatgcaatcccccaaaatgcaatgcgtcnagctatttctcacaccgaccgctagttgcggatcanaaatccgttgggcgcgga

SEQ ID NO: 362 - DNA, 335 bp, Mycobacterium tuberculosis
  modified_base (2): a, t, c or g
  modified_base (221): a, t, c or g
  modified_base (318): a, t, c or g
  modified_base (328): a, t, c or g
cntggcggtgggtgcggtgtcgaacacgaccacacttctttgcggttcggtgatctcgacaccggccgcgagccgaccaccatgcgcgcgtagatcggcgatcagcgcgtcggctatcgcctgggtgccgcccaccggaatcggccagccgaccgaatgggccagcgttgccatcatcagtccggcgccggccgacaccagtgacggcaacggtgaaatcncgtgggcggcaacgccggtgaacaacgcgcgggcatcctcgcccgccagcgaccgccaggcaggggtgccctgggccagcatccgcagcccgagacncaggaccgancccagtg

SEQ ID NO: 363 - DNA, 386 bp, Mycobacterium tuberculosis
  modified_base (8): a, t, c or g
  modified_base (125): a, t, c or g
  modified_base (164): a, t, c or g
  modified_base (199): a, t, c or g
  modified_base (220): a, t, c or g
  modified_base (239): a, t, c or g
  modified_base (284): a, t, c or g
  modified_base (358): a, t, c or g
gcttttcngatcgcagcgagtcgtacccgcgccggtcaccttcgtggatatcgccggcctggtcaagggggcgtccgagggagccgggctgggtaacaagttcctggctcatatccgcgaatgcnacgccatttgtcaggtggtgcgggtgttcgtcaacaacnacttgactcatgtcaccggacgggtcgatccccantccgacattgaggtcgtcganaccgagctgatcctggcanatctgcaaaccctggagcgggccacgggccggctggagaaggaancgcgcaccaacaaggcgcgcaagccggtctacgacgcggcactgcgtgcccagcaggtgctcgacgccggcaanacgctgttcgccgcgggggtggatgccg

SEQ ID NO: 364 - DNA, 386 bp, Mycobacterium tuberculosis
  modified_base (14): a, t, c or g
  modified_base (166): a, t, c or g
gtcgtacgccattngtcggtgtgcgcataccagtacgacgcgccgggcacctgacgcggcggccgcgaccagtcggtggccatcgccatcgtctgccacccggtcaacggacgcaccttctcctggccgacgtagtgcgcccacccgccgccgttgcgtcccatcnatccggtcaacatgagcagcgccaacaccgagcggtacatgacatcgctgtggaaccagtgacagattccgccgcccatgatgatcatcgaccgtcctccggattcggtcgcgttgcgggcgaaattccttggcaaaccggattgcctgcgcggccggcacaccggtgatcgactcctgccaggccggggtgttctgctgggttcggtcgtggtaccggt

SEQ ID NO: 365 - DNA, 335 bp, Mycobacterium tuberculosis
  modified_base (92): a, t, c or g
  modified_base (102): a, t, c or g
  modified_base (159): a, t, c or g
  modified_base (208): a, t, c or g
  modified_base (322): a, t, c or g
gcgaggcggtatcgcttcccgtcgtaccggcgaccgccagccgagaagctcgttttcccagtgttgctggggattctcacgctgctgctgantgcgtgccanaccgcttccgcttcgggttacaacgagccgcggggctacgatcgtgcgacgctgaanttggtgttctccatggacttggggatgtgcctgaaccggttcacctacnactccaagctggcgccgtctcgtccgcaggtcgttgcttgcgatagccgggaggcccggatccgcaatgacggattccatgccaacgctccgagttgcatgcggatcgaatacnaattgatcaccca

SEQ ID NO: 366 - DNA, 396 bp, Mycobacterium tuberculosis
  modified_base (171): a, t, c or g
  modified_base (350): a, t, c or g
tgggtcttgccggcgagcccagcgaagtcgctagcgtggccgtgtttcttggcttcggatctatcctcgttacatgaccggcaccgtgttggacgtgactggcggccggttcatatgacaccgagatcattgccacggtacggcaattcgtcaagaaggaaatctttcccnatgcaccggccctcgaacgtggcaacagctacccgcaagaaatcgtcgatcggctgggtgttattggcttgctcggtcgccggctgcaagggtatcgacaccaccgagttcattctcgggcgtgccggcgcattcgagctggcggtgcgcgctgcccagcaccgtcataagtacttgangatggtcaaacgtcggacgaaccgccaccacgtcgctgccgaacgg

SEQ ID NO: 367 - DNA, 262 bp, Mycobacterium tuberculosis
  modified_base (19): a, t, c or g
  modified_base (23): a, t, c or g
  modified_base (84): a, t, c or g
tagatgcccaagcttgccnttanagacctcgtcgaccaagcacggacgcgaccgtcgaaggtggcgaatccgggcttggcgtcnacccgcgtaaggcagaccagatggttcgcggcacggtcaacctgccacacggcactggtaagactgcccgcgtcgcggtattcgcggttggtgaaaaggccgatgctgccgttgccgcgggggcggatgttgtcgggagtgacgatctgatcgagaggattcagggcggctggctgga

SEQ ID NO: 368 - DNA, 303 bp, Mycobacterium tuberculosis
  modified_base (291): a, t, c or g
tctccacggcgtggatcaaggtaccggccgggatgttgcgcaatggcaggttgttgcccggcttgatgtctgcgttagcgccggattccaccacatccccttgcgaaaagtccgttgggtgcaatgatgtagcgcttctccccatcgagatagtggagcaacgcaatccgtgcggtacggttcgggtcgtactcgatgtgcgcgaccttggcgttgacaccatctttgtcattgcggcgaaagtcgatcatccggtaagcgcgcttatgaccgccgcctttgtgccgggtnggtaatccggcc

SEQ ID NO: 369 - DNA, 367 bp, Mycobacterium tuberculosis
  modified_base (321): a, t, c or g
  modified_base (332): a, t, c or g
  modified_base (343): a, t, c or g
gcccggttcgatcgggcatgtccgcagtcgtcgttaccggaggcggtcgtggccgcgctaatcggcgtcggcgccgacaagatgtgggatatccgcaatcggggcgtcatccctgcgggcgcgctcccccgcgtccgagccttcgtcgacgcaatcgaggcaagtcacgacgcggatgaggggcagcagtgaattacagcgaggtcgagctgttgagtcgcgctcatcaactgttcgccggaaacagtcggcgaccggggttggatgcgggcaccacaccctacgggggatctgctgtctcgggctgccgacctgaatgtnggtgcgggcancgccggtatcnactcccgtggaacacagccggggc

SEQ ID NO: 370 - DNA, 366 bp, Mycobacterium tuberculosis
  modified_base (37): a, t, c or g
  modified_base (88): a, t, c or g
ctcggcgtggatatcggtgtagccggcgccggtgaangtcggctccttacgtccactcgacaacagctcatagcgatccaaccagtangcaaccgccttcagcagtacaaccgcgccggcgaacactgcgagttgaacgcgagctgcctgggtcagcatgcctctgccggttgtcagccgaaggccgccgaacaggtaatgcgtcaacaggctcgctagaaacgccagaaccacggccacgaacagccagttcagcaccgaccggtagaacggcagatcgaagacgaaaaaacccaatgtcatagccgaattcggggtccacgatgccaaaggtgcccccgtgtacaacaactgaaccttcaccca

SEQ ID NO: 371 - DNA, 455 bp, Mycobacterium tuberculosis
tccggctcgtatgttgtgtggaattgtgagcggataacaatttcacacaggaaacagctatgaccatgattacgccaagctatttaggtgacactatagaatactcaagcttcacgtccgtacggctcgggtacgcttcggtcgcagtgtgcgagtgatagatgacgaccgggacctcgtcggcatcttccatagcccgccacaccttcagttgctcaccggaatccaaccggtagaaggtcggcgagcgctcggcattggtcatcgggatatgccgctcgggacggtcagagccctcgggtccggccagcactccgcaggcttcgtcggggtggtcgcgacgcgcatgggccaccatcgcattcaccaggtctgcgcgaatcaccagcacgtagacggttcctttcctaagcaacaccgaagtttcaggaccgaatgctccgggaaacatgtca

SEQ ID NO: 372 - DNA, 196 bp, Mycobacterium tuberculosis
caggcatgcaagcttgatgccgccgaaaccgagcgtgagcacgccgccagccaccacgcccgggtcgggcgccgggcccgggccgccaggctgctccgctcggtgatggcacgccaccgcgacaccacccggctgcgctacgtcgagccataccgggcggagctccatccgctcggccgccagtgtccgggccctc

SEQ ID NO: 373 - DNA, 443 bp, Mycobacterium tuberculosis
  modified_base (36): a, t, c or g
  modified_base (303): a, t, c or g
  modified_base (334): a, t, c or g
cctgcatccggctcgtatgttgtgtggaattgtgancggataacaatttcacacaggaaacagctatgaccatgattacgccaagctatttaggtgacactatagaatactcaagcttccaatccccctgccctgatacgcgtcggcaaccgtgaacgcgatctcggcgaccgtcggatcggtttcatcccgcacaaaacgcgcgtcggctacggggtcgcttccgtcggtcaccacccagacgaagtggtcgacgtagtcgacttccgacaggtagtgcatcaacgccggactgggaacacnagccgacatgaaccgtcgatacagcgtctcnccggagaactggatgtgtccgtgcacggtccgctcgcggtcaccgggcagcacggggcgtaacatcagttgagtcccgtcggcaagccgtaccggaatcggggagacga

SEQ ID NO: 374 - DNA, 445 bp, Mycobacterium tuberculosis
caagatgatcgccggtgccaccccgatccgtgcctcggtcagcgcgaacgtgctttccggtccggcgaccaccatgtcgcacgcaccgaccaggccgaacccgccggcccgcacatgcccgttgatggcgccgaccaccggcagcggcgactcgacgatggcgcgcaacagcgccgtcatttcccgcgcccgcgccaccgccatccggtacggatcaccaccaccaccgccggcctcgctgaggtccgcgccggcgcagaacgttccgccggtatgccccagcacgaccagccgcaccgccggatctgcttcggccgcactcagcccttgatgtagttggctgaccagcgtgctcgacagcgcgttgcggttgtgcggagagttcagtgtcagcctggcgaaggggccgccgcaggcggccgggccagcgtagtcgacggggctg

SEQ ID NO: 375 - DNA, 308 bp, Mycobacterium tuberculosis
  modified_base (253): a, t, c or g
  modified_base (302): a, t, c or g
ctcaagcttcgatcgacagtactcccgccttgggtctggtcttcgagctggtcggtcatggtcggacctgctggtagtggggatctaacgcaacatggtcgggattcatcatggtgtacccgtgatacccattcgcagctgccggtgaaaccccgcgatgccgggatttccagccgcactaggatgtctagccggccagccgctgccgccggacttcgggatgttcggtataccaccgatcggcaatcttgcntatccgccgatgctcgaacgctagccaccccaaaccaaccactgtgacnacaatc

SEQ ID NO: 376 - DNA, 239 bp, Mycobacterium tuberculosis
tgaatttcccgatcccacaatctcggttcagatacaggtcgccataccccttacttcggcaacgctgggcggattggccctgccgctgcagcagaccatcgacgccatcgaattgccggcaatctcgttcagccaatccatacccatcgacattccgccgatcgacatcccggcctccactatcaacggaatttcgatgtcggaggtcgtgccgatcgatgtgtccgtcgacattccgg

SEQ ID NO: 377 - DNA, 431 bp, Mycobacterium tuberculosis
  modified_base (346): a, t, c or g
  modified_base (417): a, t, c or g
tactcaagcttgaacgctgcgagcgagcccatgtagagcgtttggtaccaaaccgatcggtgggccaacttgccatgggctcacagcggctatcgcgagcgtgtagccgatcatcggccaggcgacggtggcctgagcggcaggggttgccttatccatcctcttgcggcatggttgccgcagggagtgccggtaagtctggtcggcaacctggcccgctgcgggttgggttcggattccctcggctagtaaggtgctcgcctggtgttacaacgaatcgctagacagctcttatcgggagtggccgtcgcgatcgttgcgctgccgctggcgatcgcgttcggcnttaccgccaccggaacgtcccaaggtgcgctcatcgggctctacggcgccatcttcgccggattcttcccngccgtgttcggtgg

SEQ ID NO: 378 - DNA, 334 bp, Mycobacterium tuberculosis
  modified_base (281): a, t, c or g
  modified_base (284): a, t, c or g
  modified_base (314): a, t, c or g
  modified_base (334): a, t, c or g
gcggtgtctgaacttcgcccgttccctccagcgcattgagcttcagcccgaccggcaggtagggagtcggcatgcggtccttcgccccgaccccgctggctaaatagccacccccgagcgcggtcacggtctttgcaccgggacgacggcataccggcagcgcgaacatcgccgcgggctgcagcgtgaacgtcgaatacgagtcgaacagtgtcggcgcgtaaaaacccgagccggcggtcgcttcggtaatcaacggctcctgcgcaaccagctgcaantcnccggtgccaccggcgttgacaatcttgatntcggcgacctcgcgcaccan

SEQ ID NO: 379 - DNA, 302 bp, Mycobacterium tuberculosis
  modified_base (40): a, t, c or g
  modified_base (224): a, t, c or g
  modified_base (268): a, t, c or g
  modified_base (278): a, t, c or g
tactcagcttcggctcaggtggtgctgctggtaaagttcnctgaacggtgcaggtttcgacaatgtggtgccggttcggcgggtactgccatcgagacactggcgcaggctatcgcacccgttatcggctacaaacaaatcgcggtatgcgttcttgagcatgagtcggcgaccgtcgtcatggtcgacacccacgacggaaagacgcagatcgccgtcaagcntgtgtgccgcggattatcaggactgacctcctggctgaccggcntgtttggtcncgatgcctggcgcccggccggcgt

SEQ ID NO: 380 - DNA, 240 bp, Mycobacterium tuberculosis
  modified_base (203): a, t, c or g
catcacctggttcatgaaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacancgcgttctccaccgaccgggcccgggtgtggggtgtt

SEQ ID NO: 381 - DNA, 362 bp, Mycobacterium tuberculosis
  modified_base (58): a, t, c or g
  modified_base (84): a, t, c or g
  modified_base (333): a, t, c or g
ctcaagcttcccggcggccagtaccgaaagcgcgaacagctcgcggcagcccacaacntgctgcgtcggattgccggcggcganatcaattccaggcagctcccggacaatgcggctctgctggcccgcaacgaaggactcgaggtcaccccggtgcccggggtcgtggtgcacctgccgatcgcacaggttggcccacaaccggccgcttgatgcccggtcggcaagcccggcagttgccaaacccagcgtgatcaggctcggctcgcgagttcggcgaagaagtggctcgcctgatcacctaccatcggccaggatctgcgtgtcatcacnacgctcgccaaggaggttgttgtggtgct

SEQ ID NO: 382 - DNA, 411 bp, Mycobacterium tuberculosis
gccacgtttcgcgccgcccggcatacggcggcgtaccgatctccgcgtcatacacccgcgggtaatcgccgacggtgccggttcgcgagccgaaggtgacgacgctgattgaatcgagttccaggtccagcgggtggcgcagcaacggcgcgagctcaacgacgtcaatcacgttgtcgctttctacggtcaccgacccggtgaccgtagtcgcccggtgcgctcggccgagaagttgcaccgccaccaccgcgacaccgtcttgcacgcggacgccacccccggatcggttgttggccaaggtaattgggtcattccatttgacgggacgccgaccccgcagccccagtaccgcccacgaccacgccggctgaccccaccactgtacgaacaccaaggcgacgccgacca

SEQ ID NO: 383 - DNA, 331 bp, Mycobacterium tuberculosis
  modified_base (203): a, t, c or g
  modified_base (209): a, t, c or g
  modified_base (292): a, t, c or g
ctcaagcttgatgccgcctaaaccgaagcgtgagcacgccgccacccaccacgcgcgggtcgggcgccgggcccgggccgccaggctgctccgctcggtgatggcacgccaccgcgacaccacccggctgcgctacgtcaagccataccgggcggagctacatcggctcggccgcccagtgttcgggccctctttcgaggtcnaggtcnataccgatttgcgcatccgcagccgcaccctggacgacagaaccgtgccctacgagtgcttgtcgggcggggccaaagaacancttggcatcctggcgcgattggccggcgcggtcctggtc

SEQ ID NO: 384 - DNA, 254 bp, Mycobacterium tuberculosis
  modified_base (111): a, t, c or g
  modified_base (114): a, t, c or g
  modified_base (218): a, t, c or g
ctcgggtacgcttcggtcgcagtgtgcgagtgatagatgacgaccgggacctcgtcggcatcttccatagcccgccacaccttcagttgctcaccggaatccaaccggtanaangtcggcgagcgctcggcattggtcatcgggatatgccgctcgggacggtcagagccctcgggtccggccagcactccgcaggcttcgtcggggtggtcgcgacncgcatgggccaccatcgcattcaccaggtctgcgcg

SEQ ID NO: 385 - DNA, 346 bp, Mycobacterium tuberculosis
  modified_base (256): a, t, c or g
  modified_base (258): a, t, c or g
  modified_base (265): a, t, c or g
  modified_base (275): a, t, c or g
  modified_base (297): a, t, c or g
ctcaagcttcaattcctccacgacgcgttcccaaatgaatttcccgatcccacaatctcggttcagatacaggtcgccataccccttacttcggcaacgctgggcggattggccctgccgctgcagcaaaccatcgacgccatcgaattgccggcaatctcgttcagccaatccatacccatcgacattccgccgatcgacatcccggcctccactatcaacggaatttcgatgtcggaggtcgtgccgatcgatntntccgtcnacattccggnggtcaccatcaccggcaccagnatcgacccgattccgctgaacttcgacgttctcagcagcgccggaacca

SEQ ID NO: 386 - DNA, 287 bp, Mycobacterium tuberculosis
  modified_base (28): a, t, c or g
  modified_base (53): a, t, c or g
  modified_base (269): a, t, c or g
ttaacccccgtggcctctacgccgcctncgggtcgaacatgcatcccgagcanatgctcgagcgcgcaccccactcgccgatggccggaaccggctggttacccgggtggcggctgacgttcggcggcgaggacatcggctgggaaggggcgcttgccaccgtcgtcgaagacccagattcgaaggtgttcgtcgtgctctacgacatgaccccggcggacgagaagaaccttgaccggtgggaaggctccgagttcggcatccaccanaagatccgatgccgcgtt

SEQ ID NO: 387 - DNA, 370 bp, Mycobacterium tuberculosis
  modified_base (233): a, t, c or g
ctcaagcttgattttgatcatcatggatgatcatcacccgaagtgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcctggcggtgggatccgactacaatctgctgctgatttcccggttgaaaaangaaattggggccggattgaacaccggaattatccgtgccatggctggtaccgggggagtggtgacggctgccggcatggtgttcgccgttaccatgtcgttgtttgtgttcagcgatttgcgaattattggtcagat

SEQ ID NO: 388 - DNA, 330 bp, Mycobacterium tuberculosis
  modified_base (3): a, t, c or g
  modified_base (19): a, t, c or g
  modified_base (159): a, t, c or g
  modified_base (161): a, t, c or g
  modified_base (305): a, t, c or g
cgnccaacccgaattggttttcggcgccntcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccncnggcgttaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccanacgacatcgtggcgagattcgccgg

SEQ ID NO: 389 - DNA, 346 bp, Mycobacterium tuberculosis
  modified_base (109): a, t, c or g
  modified_base (182): a, t, c or g
  modified_base (193): a, t, c or g
  modified_base (226): a, t, c or g
  modified_base (233): a, t, c or g
  modified_base (247): a, t, c or g
cgtgactgccaccggggccactccgcagaatctgtacccgaccaagatctacaccatcgaatacgacggcgtcgccgactttccgcggtacccgctcaactttgtgtcnaccctcaacgccattgccggcacctactacgtgcactccaactacttcatcctgacgccggaacaaattgacncagcggttccnctgaccaatacggtcggtcccacgatgacccantactacntcattcgcacgganaacctgccgctgctagagccactgcgatcggtgccgatcgtggggaacccactggcgaacctggttcaaccaaacttgaaggtgattgttaacctgggg

SEQ ID NO: 390 - DNA, 355 bp, Mycobacterium tuberculosis
  modified_base (13): a, t, c or g
  modified_base (24): a, t, c or g
  modified_base (353): a, t, c or g
tcgctcaagcgcntgaggccgaancggctggttacgactccctgtttgtgatggaccacttctaccaactgcccatgttggggacgcccgaccagccgatgctggaggcctacacggcccttggtgcgctggccacggcgaccgagcggctgcaactgggcgcgttggtgaccggcaatacctaccgcagcccgaccctgctggcaaagatcatcaccacgctcgacgtggttagcgccggtcgagcgatcctcggcattggagccggttggtttgagctggaacaccgccagctcggcttcgagttcggcactttcagtgaccggttcaaccggctcgaaaaggcgctacanat

SEQ ID NO: 391 - DNA, 403 bp, Mycobacterium tuberculosis
  modified_base (82): a, t, c or g
atactcaagcttccgctggggcctgttcaaccatggcgatcccgttggtcccggacatcccgaacgaggacaccgcgacccncttcggtgtgtgatcattaccgttgggccactgcgtaaccgcttgcggcacaaagagcccggtctcgacgtcggaaagctcatcgggcacccgattgaaatgcagcagcggcggcaccaccccgtgccgcagtgacagaattgccttgatcagcccgacggtccccgccgatgccgtgctgtgccccatgttgctcttggccgatccaagcgcgcagggggtgcccgcgccatacacccgcgccaggctgcggtactcaatcgggtcgccgattggcgtaccggtgccgtgcgcctccaccacaccgaccgtttcgggctg

SEQ ID NO: 392 - DNA, 440 bp, Mycobacterium tuberculosis
  modified_base (73): a, t, c or g
  modified_base (108): a, t, c or g
  modified_base (164): a, t, c or g
  modified_base (282): a, t, c or g
  modified_base (288): a, t, c or g
  modified_base (291): a, t, c or g
  modified_base (293): a, t, c or g
  modified_base (306): a, t, c or g
  modified_base (326): a, t, c or g
  modified_base (335): a, t, c or g
  modified_base (346): a, t, c or g
  modified_base (354): a, t, c or g
  modified_base (370): a, t, c or g
  modified_base (378): a, t, c or g
  modified_base (380): a, t, c or g
  modified_base (382): a, t, c or g
  modified_base (384): a, t, c or g
caacagcgttccagcggcataccaccgcacatgccgtgcacccggcgccgggcggagtcgccgcataacacangtacaccttgggaatcggtgtgcgccagggattcnaccgcggggtggggccggcgatcgcgcgccaggtcgagttggcgccgaccgtgatntcaccgccgacgtagttggcgttgtggtccgccatccgcgcggcgggcacggcgcgggccgccaccacgatgtcacggaagccgggggcgaacgctcgacgacctggttaccgtctcngtcgcntcnancgtggacccgacngcacgtgggcatatgtccanaacggacgnggccggtttcntcgatgcngccggggtccgcgacntgcggacncncngncacaccatccgccagtccgcgtggcgtcccgccgcgactctgcctcggccgcgcca

SEQ ID NO: 393 - DNA, 353 bp, Mycobacterium tuberculosis
  modified_base (12): a, t, c or g
  modified_base (36): a, t, c or g
  modified_base (61): a, t, c or g
  modified_base (83): a, t, c or g
  modified_base (343): a, t, c or g
ctcaagctttgncgacgatcgggcgatgtcgatganaggaaaccccagcgcacaaccgacnattttggcgtagccggcggacntctgctcgattccgatcacgtcggcgctcgcatcgagcatggcgccggcgacggctagcagcgatccgccgtcgtcgaggaacacgacacgagccgtacgcccggccgtaagccgcgcccaggattcggcgaaaaaccgttctacgtggcgggtgtactgggtgtccaatgattcgtggggtgcgtaggcgtcgctgcaatcgtcgacataaatgccgtcggcccgcatcgcgtcaacaactcccgggtgagtggaatancacttgccga

SEQ ID NO: 394 - DNA, 340 bp, Mycobacterium tuberculosis
tccaacgcggtgacagatttgtctatcctggacctgacggtgaggtcgaagttttccaggaattcggcaaaatcggtaagagcctgaagaattcggtatcgccggacgaaatctgcgacgcatacggggcagatacgcttcgggtttacgagatgtcgatggggccgctggaggcttcacgtccatgggccacaaaggatgttgtcggcgcgtaccgttttctgcagcgggtgtggcgcttggtcgtcgacgagcacaccggcgaaactcgggtggctgacggcgtggaactcgacatcgatacgctacgggcgttgcaccgcaccatcgtcggcgtgtc

SEQ ID NO: 395 - DNA, 362 bp, Mycobacterium tuberculosis
  modified_base (30): a, t, c or g
  modified_base (45): a, t, c or g
  modified_base (70): a, t, c or g
  modified_base (244): a, t, c or g
  modified_base (247): a, t, c or g
  modified_base (296): a, t, c or g
ctcgtccttgactacgcccagtatcgaaancctcctgtgccggtncgctaaacacccggcggacactcanacggtgctggtggtgcggcatggcaccgcgggcagcaaagcgcacttctccggggacgacagcaagcgaccgctagacaagaggggtcgtgcgcaggcagaagcgttggtaccacagctgctggcgttcggcgccaccgatgtttatgccgccgaccgggtgcgctgccaccanacnatggagccactcgccgcggaactgaacgtgaccatacacaacgagcccnccctgaccgaagagtcctacgccaacaaccccaaacgcggccgacaccgagtgctgcagatcttcg

SEQ ID NO: 396 - DNA, 356 bp, Mycobacterium tuberculosis
  modified_base (12): a, t, c or g
  modified_base (327): a, t, c or g
  modified_base (355): a, t, c or g
gtatcgcctccncctttggccaccagcagccacagcgcggttcgcggaccgaacgtggacatcaatagcccggaatcggtgtgtgcaagttggtaaacggtgttgatcccaagctttgccagccttttcgtagtcttgggccccacaccccacagtgcttcgacggtacggtcacccatgatggccatccagttggcatcggtgagctgatagatgccagctggtttcgccaacccggtagcgatcttggcgcgctgcttgttgtcactgatacctatcgagcaagacagcccggtttgcgacaagatgacttttcggatctcttcngcgaacttccaatgggggtctccgggant

SEQ ID NO: 397 - DNA, 350 bp, Mycobacterium tuberculosis
  modified_base (99): a, t, c or g
  modified_base (102): a, t, c or g
  modified_base (274): a, t, c or g
  modified_base (293): a, t, c or g
  modified_base (295): a, t, c or g
  modified_base (326): a, t, c or g
ctcaagcttttggtctagccggccgagcacgatacgggtgtccttggccaccggcggcggctgtccgggaaatggcgggtccccggtggttttgctgangantgctgaaccgtagtcgaagtgggcggcgtcagactccacccagccagcaggcagcgcgaagctgaatcctccaaccgggttgtcgatccggacaggttggggtgcgtttggggcaatgacaggtggcggcggtgcgttcgggtcggccggcggaggtgctgcgttgggatcncccggctgggcattcggcntnttggcggcggccggtggtgggggggcaacangtgtcccggtgcgggtggcgctgc

SEQ ID NO: 398 - DNA, 355 bp, Mycobacterium tuberculosis
atctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacggcgacccggcctatggttattcgacctcgccgcc

SEQ ID NO: 399 - DNA, 360 bp, Mycobacterium tuberculosis
  modified_base (41): a, t, c or g
  modified_base (59): a, t, c or g
  modified_base (198): a, t, c or g
ctcaagcttgcaatgcgggtcgggatgcccatggttggaanatggtcgccctggcgtcnaatacgcgcgagcgcatgagctcaccggttcggaacaacgtatcgaaaaacgtcgcactgctggcagatggtatctccgatgtggttgtaatttgtatcccaactctaactgtgctatcggatcagcgtgaatatcganatattgcgaatgcgatgacaggccgccattcggtttattcgcttacgcttcccgggttcgattcgtctgatgcactgccgcaaaacgcggatatgattgttgaaaccgtatctaacgcaattattgatgtggtaggcggcagctgccgttttgtgctgtcgg

SEQ ID NO: 400 - DNA, 272 bp, Mycobacterium tuberculosis
caaatacacgccggacgcacaggcggacatcgccatcccgagcacacccaaaacgggatacaggatggaggccaacgccacggccgcgcccaggatcaccaaccacaccggcttggtcagcttgtcggcggcggtataggcatcgggccgctgcaacgcagcatgcacaaacgcgtacaccgctgtcaccaagacggcgaccagcaataccagcatgacggtacccacgaggtggctcacgcattcagactatgcggtttgcatccaacacg

SEQ ID NO: 401 - DNA, 306 bp, Mycobacterium tuberculosis
ctcgtccttcggcctcgctgcaggagtgggagccgcagggctggaaatccgaaaaacgagccggtgatcgcactgtcgccgatcggcgccgcacctggttggtgttacggatgaatccgcagcgaaatgtggctgcggtggcgtgtcgtgactcgttggcgtcgacgctggtggcagccaccgagcggttggtccaggatctggatgggcaaagttgtgcggcccggccggtgacggccgatgagctgaccgaggtcgacagcgccgtgttggctgacttggaaccgacatggagtcgccccggtt

SEQ ID NO: 402 - DNA, 300 bp, Mycobacterium tuberculosis
  modified_base (7): a, t, c or g
  modified_base (90): a, t, c or g
gtctagnccgccgaacacgatacgggtgtcattggccaccggcggcggctgtccgggaaatggcgggtccccggtggttttgctgaagantgctgaaccgtagtcgaagtgggcggcgtcagactccacccagccagcaggcagcgcgaagctgaatcctccaaccgggttgtcgatccggacaggttggggtgcgtttggggcaatgacaggtggcggcggtgcgttcgggtcggccggcggaagtgctgcgttgggatcgcccggctgggcattcggcgtgttggcggcggccggtgg

SEQ ID NO: 403 - DNA, 396 bp, Mycobacterium tuberculosis
  modified_base (113): a, t, c or g
  modified_base (318): a, t, c or g
  modified_base (346): a, t, c or g
  modified_base (390): a, t, c or g
actcaagcttgagattggcgtcaacgggtgtcggcaccggcgtcctgcagttggtaggcctgcagtttgtgcatcaggccgatgccgcggccctcgtggccacgcatgtacancaccacgccgcgcccctcacgggcgaccatcgccagcgcggcgtccagctgaggcccgcaatcgcagcggcgtgacccaaacacatcgccggtcaagcactccgaatgcacccggaccagcacgtcgtcaccgtcggcgttgggcccggcgatctcgccgcggaccagcgcgacatgttccacgtcctcgtaaatgctggtgtanccgatggcgcgaaactccccatgacaantcggaatcccgcgcctcggcgaccccgctcaatgttgcttctcntgcttg

SEQ ID NO: 404 - DNA, 352 bp, Mycobacterium tuberculosis
  modified_base (6): a, t, c or g
  modified_base (19): a, t, c or g
tcgacnagcattcttgacngttgttttggctcggcatggttagccaaggttctgcggtcccaccagatcatcttggtccggtagcgctcgtccgggtatgctgccgccgggattctcgctgctattactccccccgaagaacgccaccggtccagcgcgtgggccgccgcggtccccatcacaaactgaacccccaacaggggacatgcttagcggtagggcgcgcgccaaggcggcagcaatcgcatcactgcgctgcgcgtcactattaacccacccggacttcacttccacgaccccgaatggcgcccggtcattgatcatcttgcgcaccgcggataatccgggattg

SEQ ID NO: 405 - DNA, 420 bp, Mycobacterium tuberculosis
  modified_base (36): a, t, c or g
  modified_base (99): a, t, c or g
  modified_base (174): a, t, c or g
  modified_base (207): a, t, c or g
  modified_base (216): a, t, c or g
  modified_base (237): a, t, c or g
  modified_base (321): a, t, c or g
  modified_base (328): a, t, c or g
  modified_base (345): a, t, c or g
  modified_base (353): a, t, c or g
  modified_base (369): a, t, c or g
  modified_base (385): a, t, c or g
  modified_base (408)..(409): a, t, c or g
accggggccactccgcacaatctgtacccgaccaanatctacaccatcgaatacgacggcgtcgccgactttccgcggtacccgctcaactttgtgtcnaccctcaacgccattgccggcacctactacgtgcactccaactacttcatcctgacgccggaacaaattgacgcngcggttccgctgaccaatacggtcggtcccacnatgacccantactacatcattcgcacgganaacctgccgctgctaaagccactgcgatcggtgccgatcgtggggaacccactggcgaacctggttcaaccaaacttgaaggtnattgttnacctgggctacggcganccggcctntggttattccacctcnccgcccaatgtttgcnactcccgttcggggttgttcccnnaaggtcaaccc

SEQ ID NO: 406 - DNA, 328 bp, Mycobacterium tuberculosis
  modified_base (12): a, t, c or g
  modified_base (23): a, t, c or g
  modified_base (277): a, t, c or g
cgctcaagcgcntgaggccgaancggctggttacgactccctgtttgtgatggaccacttctaccaactgcccatgttggggacgcccgaccagccgatgctggaggcctacacggcccttggtgcgctggccacggcgaccgagcggctgcaactgggcgcgttggtgaccggcaatacctaccgcagcccgaccctgctggcaaagatcatcaccacgctcgacgtggttagcgccggtcgagcgatcctcggcattggagccggttggtttganctggaacaccgccagctcggcttcgagttcggcactttcagtgaccggttc

SEQ ID NO: 407 - DNA, 315 bp, Mycobacterium tuberculosis
ctcaagcttgcgttcgatgaagtagtcgtcggtcagcgccgcctcttcgagctccttggcgatgcccagcaaggagtcatcgccgccgagcttggccaggatcttgtcggcctgttccttgacgatgcgggcccgcggatcgtagttcttgtagacacgatgaccgaaacccatcaatttgaccccggcctcgcggttcttgaccttgcgtacaaactcgctgacgtcgtcgccgctgtcgcgaatgccctcgagcatctccaggacagcctgattggcgccgccatgaagcggaccccatagtgcgttgatgcc

SEQ ID NO: 408 - DNA, 329 bp, Mycobacterium tuberculosis
  modified_base (200): a, t, c or g
  modified_base (281): a, t, c or g
ggtcaggccgagcaggcgcgaggaacgacgaacccaacaagccatggtggttggcgccgtcgagaggtcggcggtcgccacaacgggaagatcgccttgagcgtcgctcgaccgccgcctcgagttgggtcataacgaagtagctgatgccgatcatgtcgacgtttccgtcgcatcagcgtgcagcggcgacccactcnacgaggtctcggtgccgccgcggccagggcaccagcagtgacgagtccaggcgccgtcgggccaagcagtcgcggtgccanccgtggtgggtcgggcgatggttgggtgtgctcatttcgggaacgcca

SEQ ID NO: 409 - DNA, 294 bp, Mycobacterium tuberculosis
  modified_base (48): a, t, c or g
  modified_base (194): a, t, c or g
  modified_base (204): a, t, c or g
  modified_base (206)..(207): a, t, c or g
  modified_base (271): a, t, c or g
ctcgaagctttaacagcatcaaccccgccccgcaccagcaccgacacnatgtcgatgccatcgaggtgaatgtcgaactggcgcaaaccatcggcgaccgcgaccaccggcaacatgggtaccggcgatttccggtgccaatgccgacccgacgggccgctctcaccgcaggtgacctcgatcaccgagaccanccggccgttntnntcacgcacccctaccgtgtcacgcccaaaacggcgctggtggtcgattgccggagtgcaccccncacccagtgtcgtgcccggatcc

SEQ ID NO: 410 - DNA, 288 bp, Mycobacterium tuberculosis
  modified_base (168): a, t, c or g
  modified_base (210): a, t, c or g
  modified_base (228): a, t, c or g
tgatgccgcacccgatcgacggtcgttggtcggggttgactggccgcccggcgaagcagggcgtcgaccgcggcccggacgtcggcggccgtcaccggtcggccattgcccgggcgggagtcgtcgagctgaccacggtagacaagtcggcgctggccgtcgaagacnaacgtgtcgggtgtgcaggccgcggagaaggcgcgggcgacntcttgggtttcgtcgtanagatacgggaacgtccagccgtggcggcgggcctcggcgaccatctgatcgggcccgtcc

SEQ ID NO: 411 - DNA, 420 bp, Mycobacterium tuberculosis
  modified_base (20): a, t, c or g
  modified_base (27): a, t, c or g
  modified_base (51): a, t, c or g
  modified_base (98): a, t, c or g
  modified_base (148): a, t, c or g
  modified_base (214): a, t, c or g
  modified_base (293): a, t, c or g
  modified_base (299): a, t, c or g
  modified_base (313): a, t, c or g
  modified_base (328): a, t, c or g
  modified_base (342): a, t, c or g
  modified_base (356): a, t, c or g
tttcgggcgaggcggtatancttcccntcgtaccggcgaccgccagccganaagctcgttttcccagtgttgctggggattctcacgctgctgctgantgcgtgccaaaccgcttccgcttcgggttacaacgagccgcggggctacnatcgtgcgacgctgaagttggtgttctccatggacttggggatgtgcctgaaccggttcacctacnactccaagctggcgccgtctcgtccgcaggtcgttgcttgcgatagccgggaggcccggatccgcaatgacggattccntgccancgctccgagttgcntgcggatcgactacnaattgatcacccanaaccatcgggcgtnttactgcctgaagtacctggtgcgggtcggatactgctatccggcggtgacaaccccggcaagc

SEQ ID NO: 412 - DNA, 378 bp, Mycobacterium tuberculosis
  modified_base (341): a, t, c or g
gttttggctcggcatggttagccaaggttctgcggtcccaccagatcatcttggtccggtagcgctcgtccgggtatgctgccgccgggattctcgctgctattactccccccgaagaacgccaccggtccagcgcgtgggccgccgcggtccccatcacaaactgaacccccaacagggacatgcttagcggtagggcgcgcgccaaggcggcagcaatcgcatcactgcgctgcgcgtcactattaacccacccggacttcacttccacgaccccgaatggcgcccggtcattgatcatcttgcgcaccgcggataatccgggattgccagcccattcnactaccgcatgcgagtcatcggctgaccgcagcggtc

SEQ ID NO: 413 - DNA, 347 bp, Mycobacterium tuberculosis
  modified_base (33): a, t, c or g
  modified_base (69): a, t, c or g
  modified_base (91): a, t, c or g
  modified_base (254): a, t, c or g
tcgcctaggcgggcttccccttccgtccgagcngtcagaagctcctatgacaatgcactacccgagacnatcaacggcctatgcaataccnagctgatcaaacccggcaagccctggcggtccatcgaggatgtcgagttggccaccgcgcgctgggtcgactggttcaaccatcgccgcctctaccggtactgcggcgacatcccgccggtctaactcgacgccgcctcactacgctcaacgccagagaccanccgccggctgacgtctcagatcagagagtctccggactcaccggggcggttcatccccactgtcgatagcgtctgtggataactttgtctgca

SEQ ID NO: 414 - DNA, 165 bp, Mycobacterium tuberculosis
  modified_base (7): a, t, c or g
  modified_base (37): a, t, c or g
gcgcgtngaactgataggtgcggcccggctcgagcangccggccatttgttcgatgcggttaccgaagatctcttcggtgacctgcccgccgccggccagctcggcccagtgcccggcgttggccgccgcggcgacaatcttggcgtccacggtggtctgggtca

SEQ ID NO: 415 - DNA, 317 bp, Mycobacterium tuberculosis
  modified_base (57): a, t, c or g
ctcaagcttcaatacagagttataaactgtgataatcaaccctcatcaatgatgacnaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaataactgtgacaaattaccctcagtaggtcagaacaaatgtgacgaaccaccctcaaatctgtgacagataaccctcagactatcctgtcgtcatggaagtgatatcgcggaaggaaaat

SEQ ID NO: 416 - DNA, 379 bp, Mycobacterium tuberculosis
  modified_base (236): a, t, c or g
  modified_base (277): a, t, c or g
  modified_base (302): a, t, c or g
ctcaagcttcgatcgacattactcccgccttgggtctggtctccgagctggtcggtcatggtcggacctgctggtagtggggatctaacgcaacatggtcgggattcatcatggtgtacccgtgatacccattcgcagctgccggtgaaaccccgcgatgccgggatttccagccgcactaggatgtctagccggccagccgctgccgccggacttcgggatgttcggtataccancgatcggcaatcttgcgtatccgccgatgctcgaacgctanccacgccaaaccaaccactgtgacnacaatcgccaccacaccaaaggtcatgccctcggcgtgatgtccggtgccgaaagccgcaagagctccgacgccgcc

SEQ ID NO: 417 - DNA, 420 bp, Mycobacterium tuberculosis
  modified_base (21): a, t, c or g
  modified_base (104): a, t, c or g
cattcccaattgaatttcccnatcccacaatctcggttcagatacaggtcgccataccccttacttcggcaacgctgggcggattggccctgccgctgcagcanaccatcgacgccatcgaattgccggcaatctcgttcagccaatccatacccatcgacattccgccgatcgacatcccggcctccactatcaacggaatttcgatgtcggaggtcgtgccgatcgatgtgtccgtcgacattccggcggtcaccatcaccggcaccaggatcgacccgattccgctgaacttcgacgttctcagcagcgccggacccatcaacatctcgatcatcgacattccggcgctgccgggctttggcaactcgaccgagctgccgtcgtcgggcttcttcaacaccggcggcggtggcggct

SEQ ID NO: 418 - DNA, 255 bp, Mycobacterium tuberculosis
  modified_base (26)..(27): a, t, c or g
ctcaagctttcggcggagacggacannttgcgaacattgatgacaaaatagaaatcattgatggtttgagtcaccaggccgatcaagccttcgccgagccaaattccaatcaagaggcccaagcccgtaccaatcagcccggcaacgagggattccgtcattatcagccaaaataactgctctcgggttacacccaaacagcgcaatatggcgaaaaacggtcgccgttgcacgacattaaatgtcacggtattg

SEQ ID NO: 419 - DNA, 359 bp, Mycobacterium tuberculosis
  modified_base (64): a, t, c or g
  modified_base (78): a, t, c or g
  modified_base (244): a, t, c or g
agcttaactgctccctaatacctggggctgtgcctgcggtgtatgcacggcatacggacatccntcccctgagacccncggtctaatcagccacgtgtccaccatcaggggtcaaccccggccaagggcgacggcaccccaagttcgccgaccgttaacctattgctgtgagcttcatttgctgcgagcaaaacagttggtcggccgttaggaactgaattgacactcaaccgatttggtgccnccgtaggtgtcctggctgcgggtgcgctggtgttgtccgcgtgtggtaacgaccacaatgtgaccgggggaggtgcaaccactggccacgcgtccgcgaatgtctattgcggggg

SEQ ID NO: 420 - DNA, 314 bp, Mycobacterium tuberculosis
ctcaagcttggggtggcgctgtcggtcggtgtgcttggcggcgtcggtatcaacaccgcccacgaaatggggcacaagaaggattcgctggagcggtggctgtccaaaatcaccctcgcccagacctgctacgggcacttctacatcgagcacaaccgtggccatcacgtccgggtgtccacaccggaggacccggcgtcggcgcggttcggcgaaacgttgtgggagttcctgccccgcagtgttatcggcggcttgcgctcggccgttcatttggaggcccaacggctgcgtcggctcggcgtcagccccct

SEQ ID NO: 421 - DNA, 280 bp, Mycobacterium tuberculosis
  modified_base (162): a, t, c or g
gcaccaaggccccacacgtcaccctgtgacctcctgcgccgaccccgcccgaggtcctggccgttaccacctgaacgggcgagccgggagtctggtacgcatcgaacaaagagcaaggtgcatgggcggagttgttccgccacttcgtcgatgacggggtcnatccattcgaggtccgtcgccgcgtcggtcgagtggcggtcacactccaggtactcgacctcacagacgagaggactcgatcccatctaggtgtggacgaaacagatcttctgtccga

SEQ ID NO: 422 - DNA, 230 bp, Mycobacterium tuberculosis
  modified_base (145): a, t, c or g
  modified_base (230): a, t, c or g
tcgcctccgcatatgggtcgacgccaagcgggtccggatttctgggcttcatcgctcgcgccgtcgcgacaaacagcgcggtcgaaccgacactcgttgtgatgtcccagctatcaccttcggtacgcacccaatcgaccctacncggctatctcagccgcgatctccaggctccgccgagccaggtgcatcccggtccggatcccactaacccggcaccattggcgtcn

SEQ ID NO: 423 - DNA, 272 bp, Mycobacterium tuberculosis
  modified_base (21): a, t, c or g
  modified_base (25): a, t, c or g
gtcctcgagtgccgccgtcgncacncccagcgcccgcgcggccacttggatgcgacccgtttcaagtcccttcatcatctgcgaaaagccttgacccatggctccgcccaggatcgccgagaccggcacccggaggttgtcgaacgacagctcgcaggattcgacgcccttgtaacccaacttcggcaagtcccgcgacaccgtgagtcccggcccgggttcgacgagcacgatcgacatgccttggtgccgcggtgtggcgttcgggtcgg

SEQ ID NO: 424 - DNA, 423 bp, Mycobacterium tuberculosis
  modified_base (69): a, t, c or g
  modified_base (76): a, t, c or g
  modified_base (81): a, t, c or g
  modified_base (93): a, t, c or g
  modified_base (104): a, t, c or g
  modified_base (141): a, t, c or g
  modified_base (173): a, t, c or g
  modified_base (179): a, t, c or g
ggcataccaatgtggacttctgctcacccacgatatccgtggtctgatccgctgctgcggcgggctgcnacctgcntctcngcggcacccgtnactacatggcncgcgccgcacgcatacgtcgcggcgggacccactccnactggtcgacggtgctggccgcgtgtccgcangtcccnaacccggccgcaccgacgaaaccggccgccgtccgttctggaccaacgctcatgtgccgtcggggtccatgctcgacgccatcgagaccgtaaccagcgtcctcgagcggttcgcctccggcttccgtgacatcttcgtggctgctcgcgccgtgccgccgcgcggatggtcgaccacaacgccaaccacctcggcggtgacatcaccgtccgcgccactcgacctggcgcgcgatcgcggccc

SEQ ID NO: 425 - DNA, 315 bp, Mycobacterium tuberculosis
  modified_base (18): a, t, c or g
  modified_base (55): a, t, c or g
  modified_base (245): a, t, c or g
  modified_base (269): a, t, c or g
  modified_base (286): a, t, c or g
  modified_base (308): a, t, c or g
gtgagcagacctacgccncctggttgcgccaactcggtaccgatcatggcgcgcngcctgtcgtcaccgatacccagcgaacaagacagcccggtccgcgacaagatgactttcccgatctcttcggcgacttccatggggtcgtccggagtcccgggcgccaccgcgaggtaaccctcgtctcagtcccatacgcgaccgggtatccacgtcgcgcaacaacgccaccacctccccagacgccncgttgtacgcggctgggttccacngcaataagtggcctcanggcatcgtccggcggcggtccncaacgca

SEQ ID NO: 426 - DNA, 335 bp, Mycobacterium tuberculosis
ctcaagcttgaggttaactttgaacggatcgagctggacgttcgagacggtgatcgggccgaacctgaattgtccggtaatgcccaacgcaaaaagcagggtggtggccggggcggtgaaaccggcgtcggcggcaccgtcgaaatctatgtggattgccggaatggggatgtccggcacggcgaaaccgtagttcgcttgtcccgtgaggcccaggtggatggggggaaagatcctggtgtccgggataataatggggccgatgccgccggttgaagtccactggatcgggaattccggaatcttgatccgacgttcaggccgaacaggccctc

SEQ ID NO: 427 - DNA, 346 bp, Mycobacterium tuberculosis
  modified_base (188): a, t, c or g
  modified_base (226): a, t, c or g
cggcgacgtcgcgatacgccgagcagttgggaatcgctctgcagcaaaccaatattctgcgcgacgttcgagaggactttttgaatggacggatctacctgccgcgcgacgagctggaccgattaggcgtacgcctccgcctggacgacaccggggcactcgatgaccccgacggacggctcgcggcnctgctgcggttcagtgccgaccgcgccgcagactggtnttcgctgggactgcggctgattccacacctcgaccgccgcagcgctgcctgctgtgcggccatgtctggcatctaccgccgtcagctcgccttgatcagagcatcgccggcggtcgtcta

SEQ ID NO: 428 - DNA, 332 bp, Mycobacterium tuberculosis
  modified_base (137): a, t, c or g
  modified_base (149): a, t, c or g
  modified_base (212): a, t, c or g
  modified_base (218): a, t, c or g
  modified_base (254): a, t, c or g
  modified_base (258): a, t, c or g
  modified_base (283): a, t, c or g
  modified_base (318): a, t, c or g
ctataaaatactcaagcttgatgccgccgaaaccgagcgtgagcacgccgccagccaccacgcgcgggtcgggcgccgggcccgggccgccaggctgctccgctcggtgatggcacgccaccgcgacaccacccggntgcgctacgtcnagccataccgggcggagctacatcggctcggccgcccagtgttcgggccctctttcgaggtcnaggtcnataccgatttgcgcatccgcagccgcaccctgaacnacanaaccgtgccctactattgcttgtcnggcggggccaaaaaacagcttggcatcctggcccnattggccggcgcgg

SEQ ID NO: 429 - DNA, 276 bp, Mycobacterium tuberculosis
  modified_base (249): a, t, c or g
  modified_base (253): a, t, c or g
  modified_base (260): a, t, c or g
  modified_base (263): a, t, c or g
cttcggtcgcagtgtgcgagtgatagatgacgaccgggacctcgtcggcatcttccatagcccgccacaccttcagttgctcaccggaatccaaccggtagaaggtcggcgagcgctcggcattggtcatcgggatatgccgctcgggacggtcagagccctcgggtccggccagcactccgcaggcttcgtcggggtggtcgcgacgcgcatgggccaccatcgcattcaccaggtctgcgcgaatcnccancacgtanacngttcctttcctaa

SEQ ID NO: 430 - DNA, 420 bp, Mycobacterium tuberculosis
  modified_base (99): a, t, c or g
  modified_base (113): a, t, c or g
  modified_base (164): a, t, c or g
  modified_base (195): a, t, c or g
  modified_base (233): a, t, c or g
  modified_base (243): a, t, c or g
  modified_base (263): a, t, c or g
  modified_base (284): a, t, c or g
  modified_base (389): a, t, c or g
  modified_base (397): a, t, c or g
ctggcaccaaggccccacacgtcaccctgtgacctcctgcgccgaccccgcccgaggtcctggccgttaccaccgaacgggcgagccgggagtctggtncgcatcgaacaaanagcaaggtgcatgggcggagttgttccgccacttcgtcgatgacggggtcnatccattcgaggtccgtcgccgcgtcggtcnagtggcggtcacactccaggtactcgacctcacagacnaaaggactcnatcccatctaggtgtggacnaaacagatcttctgtccgacnactacaccaccacccaggccatcgccgccgcccgcgatgccaacttcgacgccgtactggccccggcggggggcgctccccggttgtcaacacttgccgtgttcnttcacgcnctgccccacatccaaccccaacg

SEQ ID NO: 431 - DNA, 130 bp, Mycobacterium tuberculosis
gttcttgggcccatgcggaggtatcgccgtttccaccacgcggtcggggtggcgttgcattagctcaccgatggtgcgcttgtgcaggccgccgggataccccgagtgccggtaaaccatcttgtgctgc

SEQ ID NO: 432 - DNA, 215 bp, Mycobacterium tuberculosis
  modified_base (81): a, t, c or g
  modified_base (84): a, t, c or g
caatactcaagcttggcgtgccgttccaacccgaattggctttcggcgccatcggtgaggacggcgtgcgggtgctcaacnacnacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatc

SEQ ID NO: 433 - DNA, 360 bp, Mycobacterium tuberculosis
  modified_base (2): a, t, c or g
cntcatgatgatcatcacccgaagtgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcctggcggtgggatccgactacaatctgctgctgatttcccggttgaaagaggaaattggggccggattgaacaccggaattatccgtgccatggctggtaccgggggagtggtgacggctgccggcatggtgttcgccgttaccatgtcgttgtttgtgttcagcgatttgcgaattattggtcagatcggtaccac

SEQ ID NO: 434 - DNA, 265 bp, Mycobacterium tuberculosis
  modified_base (26): a, t, c or g
  modified_base (135): a, t, c or g
  modified_base (176)..(177): a, t, c or g
  modified_base (199): a, t, c or g
  modified_base (263): a, t, c or g
atactcaagcttttacggtgatcgcncatcacctggttcatgaactggaagcagcgcagcgcttccttttcggccgcaacatgagccagcctctcgtcggcggtcgggtgcaggtgctcgggcagctcggccgcnacagccgcctgaccctgaaaccagcttccatatcccgcgannaacgacgccagtccgctacgtnacccctccgcgactgtccatggacaacagcgcgttctccaccgaccgggcccgggtgtggggtntt

SEQ ID NO: 435 - DNA, 264 bp, Mycobacterium tuberculosis
gctggtagagtcgctgaccggtgcaggtttcgacaatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcg

SEQ ID NO: 436 - DNA, 335 bp, Mycobacterium tuberculosis
  modified_base (26): a, t, c or g
  modified_base (224): a, t, c or g
  modified_base (254): a, t, c or g
  modified_base (261): a, t, c or g
  modified_base (286): a, t, c or g
gctttccgccgatacccgccatgtcncgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcancactcaatgccgaccaggccgaggccgganacaaaantatcgctaaggtcaccgcgatcacnagcatggtgatcgcagcaatgttgctagtgatctatcgctccgtaatta

SEQ ID NO: 437 - DNA, 304 bp, Mycobacterium tuberculosis
  modified_base (250): a, t, c or g
cttccaacccgaattggctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccangtcgcccgggcgcacggtgcggacaaggtggtgctggcggtcccgatcggccca

SEQ ID NO: 438 - DNA, 223 bp, Mycobacterium tuberculosis
  modified_base (136): a, t, c or g
  modified_base (158): a, t, c or g
  modified_base (203): a, t, c or g
tactcaagcttcgcgagatccggatggcactcacgctggacaagaccttcacaaaatctgaaatcctgacccgatacttgaacctggtctcgttcggcaataactcgttcggcgtgcaggacgcggcgcaaacgtncttcggcatcaacgcgtccganctgaattggcagcaagcggcgctgctggccggcatggtgcaatcnaccagcacgctcaacccgta

SEQ ID NO: 439 - DNA, 263 bp, Mycobacterium tuberculosis
cccacgactttctcctcgatcagttggatttgtacgaagaggcaacgaaagcagtgatcctcgggatggtcgacgcctacatcgacccgccgttcacgccgcacagcctgctagatgcgctgggcgagcaggtcccacagttcgccgctaaggcacggcgtctgttcccgtccggatcgccattcggcctcggcgtcctgctcccattcgatcaatagggctggcagctccgtcggcaggggcctacgcctcaccccgtcacg

SEQ ID NO: 440 - DNA, 301 bp, Mycobacterium tuberculosis
  modified_base (60): a, t, c or g
  modified_base (109): a, t, c or g
  modified_base (111): a, t, c or g
  modified_base (174): a, t, c or g
  modified_base (179): a, t, c or g
  modified_base (226): a, t, c or g
  modified_base (260): a, t, c or g
  modified_base (264): a, t, c or g
  modified_base (273): a, t, c or g
  modified_base (298): a, t, c or g
ctcaagcttatgcgcgccggccgaggtctgctcacggcaacccctgaagtttaggggacnacctactcagcgcaaaatttcgctaatgtgagtccgccccaccaggggnanatcaacccatgtcgatcatgatctacccggataccggattggcggtagcgcccacgatcgtcnaaatntccgcctgaatcatcggatagctgatccggcgtcaacgcgttttganttcaccgcgcaacagccgccaggccggcccgcancganccgatctcntcgggccgcatgggccccaatcttntcg

SEQ ID NO: 441 - DNA, 90 bp, Mycobacterium tuberculosis
gtgtgtggtggaacccatctgagcagtgtgccaaaccggggcagacagctcccaattgacgtgagcccgctcacttgctgggtaagcgtc

SEQ ID NO: 442 - DNA, 183 bp, Mycobacterium tuberculosis
ctttacacttcctgcatccggctcgtatgttgtgtggaattgtgagcggataacaatttcacacaggaaacagctatgaccatgattacgccaagctatttaggtgacactatagaatactcaagcttgggcgtgacggccaccggggccactccgcaccatctgtacccgaccaagatctac

SEQ ID NO: 443 - DNA, 348 bp, Mycobacterium tuberculosis
  modified_base (94): a, t, c or g
caggcatgcaagctttagctgcccgaatgcgtcaccccgatgcgcccagatcggggcttcgcagataaagcacgaacaggcgggcaaaacgtcnatctcggagccggaagggcaatcagccgaccgtcgacgaacgacaccggcgagaccacttaggcagtgacggccggcccgaacattacgcgctcgttgattaggcgttcggtctcgtccgcggtcatgccgagcagcttgcggcagatctgaacgctgtcctgtccgggcagcggcgccgggcgttggggtgcctgcccgaatgtgacgaaacggagccggacccgtctcggcgggccgcggacggcgatccgc

SEQ ID NO: 444 - DNA, 335 bp, Mycobacterium tuberculosis
  modified_base (2): a, t, c or g
  modified_base (43): a, t, c or g
  modified_base (84): a, t, c or g
  modified_base (130): a, t, c or g
  modified_base (132): a, t, c or g
  modified_base (203): a, t, c or g
  modified_base (280): a, t, c or g
  modified_base (291): a, t, c or g
  modified_base (309): a, t, c or g
  modified_base (313): a, t, c or g
cncaagcttgcggatgttacccctgacagcctgaactatgtcnaaacacacggcaccggaacggtgttgggggaccccatcganttcgagtcgctggcggccacttatggcctgggtaaaggccagggcnanagcccgtgcgcattggggtcggtcaaaaccaacatcggccacctggaggcggccgccggtgtggctggatncatcaaggcggtgctggcggtgcaacgtgggcacattccccgcaacttgcacttcacccggtggaacccggccatcnacgcgtcggcnacgcggctgttcgtgccnaccnaaaaccccccgtggccggcggc

SEQ ID NO: 445 - DNA, 289 bp, Mycobacterium tuberculosis
  modified_base (155): a, t, c or g
  modified_base (212): a, t, c or g
  modified_base (249): a, t, c or g
  modified_base (251): a, t, c or g
  modified_base (289): a, t, c or g
ggaaccggtaaccagatcagctcgtcgacctcactgccgggggtgaattccccaccggtgctgcgcgctgcccagtagtgcaccttcttgacgcctcgaaaaggggagtcggtcgggtaggtcaccgtcaggagccgcctacccaggttggcgcnatagccggtctcctcgagtatctcccgcaccgcccccaccggtgcggtctcacccanatccactttgcccttgggcagcgaccagtcgtcgtancnggggcggtgaatgacaacgatctcgaccggcccttccn

SEQ ID NO: 446 - DNA, 263 bp, Mycobacterium tuberculosis
  modified_base (33): a, t, c or g
tactcaagcttcagaacaggcctgttgtgggcncacccggctcgccgagttctgcacgcaccgcctcaagtgcggcccgcaccgccggcatctcccggtcacgcagggccgcggcccgcgccgcagcgacggcgtgttcgcgcagttcgccgtcaatgatgctgacctgatcggccacccgggcgttctcggcgtcgtcgcgttcactaatcgcggtgctcagcagcgtctcgacagccaccacccgagtggcgaccagctgc

SEQ ID NO: 447 - DNA, 279 bp, Mycobacterium tuberculosis
taatgtcttgccaacgtcaccacaatcgcgatgaattcaatcatgccgcccagggcggccaacccaatggtggccgcgagcggcagctcgatcgcagcgcggaggttgccggccgccagttgattcacgaacagggtgaggtcataggcgggcaggatagtgacgaaggcaagacctatatctgccgtcggaagaagaatcgagtagccggtcgacacaacggaagcgaaagtgtccgcgatgttgatgagcgtcgccggttgtggcggcggtggcggc

SEQ ID NO: 448 - DNA, 295 bp, Mycobacterium tuberculosis
  modified_base (136): a, t, c or g
  modified_base (268)..(269): a, t, c or g
tactcaagctttcgtcagttcatcgcgccagcagaccaacaagagcatcgggacatacggagtcaactacccggccaacggtgatttcttggccgccgctgacggcgcgaacgacgccagcgaccacattcagcanatggccagcgcgtgccgggccacgaggttggtgctcggcggctactcccagggtgcggccgtgatcgacatcgtcaccgccgcaccactgcccggcctcgggttcacgcagccgttgccgcccgcagcggannatcacatcgccgcgatcgccctgttc

SEQ ID NO: 449 - DNA, 280 bp, Mycobacterium tuberculosis
  modified_base (25): a, t, c or g
  modified_base (33): a, t, c or g
ccacccgtgtaatttgggatgggcnaaaaggcnaagcaccgcgtggccacgaacgccgggagggacaatctcgggcggctagggcttctcgcgggaaggcccgaacgtacggcgtttcaacacgtcgcgtcgccctccgaccgcgaacattcggggatggcagcaacctggtagcaccctggccgggcgatgatctgcagcgtcgccgcgggtagtcgccgcccgggcggctacagtctgaaacgcgatgaccatcgatgtgtggatgcagcatccgacg

SEQ ID NO: 450 - DNA, 320 bp, Mycobacterium tuberculosis
  modified_base (28): a, t, c or g
  modified_base (37): a, t, c or g
  modified_base (57): a, t, c or g
  modified_base (67): a, t, c or g
  modified_base (87): a, t, c or g
  modified_base (112): a, t, c or g
  modified_base (122): a, t, c or g
  modified_base (140): a, t, c or g
  modified_base (176): a, t, c or g
  modified_base (233): a, t, c or g
  modified_base (295): a, t, c or g
  modified_base (312): a, t, c or g
tcaagctttagctgcccgaatccgtcancccgatgcncccagatcggggcttcgcanataaagcacnaacaggcgggcaaaacgtcnatctcggagccggaagggcaatcanccgaccgtcnacaaacgacaccggcganaccacttaggcagtgacggccggcccgaacattacncgctcgttgattaggcgttcggtctcgtccgcggtcatgccgagcagcttgcggcanatctgaacgctgtcctgtccgggcagcggcgccgggcgttggggtgcctgcggaatgtgacnaaacggagccggacccntctcggcg

SEQ ID NO: 451 - DNA, 203 bp, Mycobacterium tuberculosis
  modified_base (22): a, t, c or g
  modified_base (28)..(29): a, t, c or g
  modified_base (35): a, t, c or g
  modified_base (68): a, t, c or g
  modified_base (167): a, t, c or g
  modified_base (173): a, t, c or g
ccggggccactccgcacaatcngtaccnnaccaanatctacaccatcgaatacgacggcgtcgccgantttccgcggtacccgctcaactttgtgtcgaccctcaacgccattgccggcacctactacgtgcactccaactacttcatcctgacgccggaacaaatngacgcntcggttccgctgaccaatacggtcggtccc

SEQ ID NO: 452 - DNA, 287 bp, Mycobacterium tuberculosis
  modified_base (1): a, t, c or g
  modified_base (23): a, t, c or g
  modified_base (130): a, t, c or g
  modified_base (193): a, t, c or g
  modified_base (236): a, t, c or g
  modified_base (244): a, t, c or g
nctggcctttggtccacactaanacaatactcaagcttccggccgcagagccgccaactcacgatatcgttaaccgatatcccgagccgatagctggcgggctcgggtggtggccagcggcgctgcgacnaaaggtgtgaccgtcatgaaacagacaccaccggcggccgtcggccgtcgtcacctgctcganatctcagcatccgcagccggtgtgatcgcgctttcggcgtgtngtgggtcnccgcccgagcccggcaaaggccggcccgacacaaccccggaac

SEQ ID NO: 453 - DNA, 272 bp, Mycobacterium tuberculosis
catctgcccaccacacggaccgcggtgcggacgcggctgacgcgcctggtggtcagcatcgtggccggtctgctgttgtatgccagcttcccgccgcgcaactgctggtgggcggcggtggttgcgctcgcattgctggcctgggtgctgacccaccgcgcgacgacaccggtgggtgggctgggctacggcctgctattcggcctggtgttctacgtctcgttgttgccgtggatcggcgagctggtgggccccgggccctggttggcact

SEQ ID NO: 454 - DNA, 364 bp, Mycobacterium tuberculosis
  modified_base (103): a, t, c or g
  modified_base (127): a, t, c or g
  modified_base (257): a, t, c or g
  modified_base (279): a, t, c or g
  modified_base (304): a, t, c or g
  modified_base (319): a, t, c or g
  modified_base (321): a, t, c or g
  modified_base (324): a, t, c or g
  modified_base (351): a, t, c or g
gacaatactcaagcttgactggccacccaccggcatgaccaccgacaggcccgactggtcgtaccactcgaacgccggggtgttgatgtcccagccgctgaantcgtcctgcgcgcgcaggccgtcnaacaggtacagggcgggcgaattggcaccaccactttggaattggaccttgatgtcacggcccatcgacggcgacggcacctgcaggtactccaccggcaagcccggccgggaaaatgcccccgcggtcnccgtgccaccgacggcgccgancaaacccgacactagggccgcgccnacggccccgaccacnantcnacgcgacatacccgtgacggcgccacnaaccctgtcaaca

SEQ ID NO: 455 - DNA, 360 bp, Mycobacterium tuberculosis
  modified_base (25): a, t, c or g
  modified_base (50): a, t, c or g
  modified_base (153): a, t, c or g
  modified_base (272): a, t, c or g
  modified_base (329): a, t, c or g
cctccaactcggcggggaagcgacnccagcctaccgagcttggagtccangacgccagcggcggcgtcggtctgcgtcgtggtgccgccggggtggcgttggctggcaacgatctccacccagccggtcgggttacccacgatctcggcatanacgcgggccgaggccggtgcgataccgtattgcgtcaattgggacgcggttgtgcattcggctagctcggttgccacacccgtcaggggttcgacgttggcgggttcggcgggccccancaccgctgtcaccatgcccgccaagccgacctgcggcgccaccaactgcagcaccancatgtcgccgtcgcgcgccgcgatcacatgg

SEQ ID NO: 456 - DNA, 311 bp, Mycobacterium tuberculosis
  modified_base (30): a, t, c or g
  modified_base (51): a, t, c or g
  modified_base (58): a, t, c or g
  modified_base (85): a, t, c or g
  modified_base (99): a, t, c or g
  modified_base (127): a, t, c or g
  modified_base (242): a, t, c or g
  modified_base (277): a, t, c or g
ctcaagctttttgagcgtcgcgcggggcancttcgccggcaattctactancgagaantctggcccgatacggatctgaccgaantcgctgcggtgcancccaccctcattggcgatggcgccgacnatggcgcctggaccgatcttgtgccgcttgccgacggcgacgcggtaggtggtcaagtccggtctacgcttgggcctttgcggacggtcccgacgctggtcgcggttgcgccgcnaaagcggcgggtcgggtgccatcaggaatgcctcnccgccgcggcactgcacggccagtgccgcggcga

SEQ ID NO: 457 - DNA, 288 bp, Mycobacterium tuberculosis
  modified_base (2): a, t, c or g
cnccagcttgattggtctggttgcattggccagctgcgcgagcctggctcacttcaactacgacgaccgcaaacaattgccgccttcggatccgagttcggttgggtacgcggcaatggagcaccatttctcggtgaatcagactattcctgagtacttgatcatccactctgcacacgacctgcgaaccccgcgcggccttgccgacctggagcagctggcgcaacgtgtgagccagatcccaggcgttgccatggttcgcggtgtgacccggccaaacggggaaac

SEQ ID NO: 458 - DNA, 256 bp, Mycobacterium tuberculosis
  modified_base (66): a, t, c or g
  modified_base (206): a, t, c or g
  modified_base (240): a, t, c or g
caatactcaagcttgactgggcccgcaccttcggcgccacccacaccgtcaacgcccgcgaagtcnacgtcgtccaggccatcggcggcctcacggatggattcggcgcggacgtggtgatcgacgccgtcggccgaccggaaacctaccagcaggccttctacgcccgcgatctcgccggaaccgttgtgctggtgggtgttccnacgcccgacatgcgcctggacatgccgctggtcnacttcttctctcacgg

SEQ ID NO: 459 - DNA, 327 bp, Mycobacterium tuberculosis
  modified_base (166): a, t, c or g
  modified_base (169): a, t, c or g
  modified_base (173): a, t, c or g
  modified_base (175): a, t, c or g
  modified_base (219): a, t, c or g
  modified_base (230): a, t, c or g
  modified_base (307): a, t, c or g
tcgacggtttggcggccttaaatgcactgaggtcgtcaattgaccccacagcggaaatgccgactattcgcaggcctccttcgccttggctgccggagaggggctccgcgggaaccgcatgcaggtatatgacctcggtttctcgggtgctaccgcgtgccttgtntangatnanctcggcgttggaattgtccagccggcccaattcatcgagcgcanattcgtacacntggccggcggcgacatacgcttcaccgtggatctgctccacacggaccgccctgtcgggatcctgctcacgggtaanggaacttacgtggcactcgg

SEQ ID NO: 460 - DNA, 100 bp, Mycobacterium tuberculosis
  modified_base (41): a, t, c or g
gaccacgccaggctaatcacgtgacgctaccgaataccctncctagtggtgcaggctcccgctggaaatggccctgtaccaactcgcgcaccggtgccag

SEQ ID NO: 461 - DNA, 114 bp, Mycobacterium tuberculosis
  modified_base (114): a, t, c or g
cggcacccgacccctttgagccgtccgccgtggccgcggtggaactggccgacgagggactgatcgtgctgggcaaattggtcgatggcacgctggccgccgatctgaaggtcn

SEQ ID NO: 462 - DNA, 287 bp, Mycobacterium tuberculosis
  modified_base (174): a, t, c or g
  modified_base (177)..(178): a, t, c or g
  modified_base (265): a, t, c or g
  modified_base (267): a, t, c or g
ctcaagcttgccgttaccccgacttccggagggacaccatgagcaccgccagccgagcacgaggccaaactccgccgacgcaggccggttggacttgtcgtgctggacaaggggtttagccgccgaagcagtgacgtacatcggcgaaaagcagttcgcctgtcgaccgacggngcnnaccgtgaggctagggaagcgaggagcacatggccgccgacccgcaatgtacacgctgcaagcaaaccatcgaacccggatggctatncntcaccgcccatcgccgcggt

SEQ ID NO: 463 - DNA, 288 bp, Mycobacterium tuberculosis
catgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggagacaaaagtatcgctaaggtcaccgcgatcacgagcatggtgatcgcagcaatg

SEQ ID NO: 464 - DNA, 255 bp, Mycobacterium tuberculosis
  modified_base (78): a, t, c or g
  modified_base (104): a, t, c or g
atactcaagcttcggtacggtggcgggccgtgctgctggccgcggtcgcggcgtgcgcggcctgcggtctcgtttacnagctcgcgctgctgacactggcggcnagcctgaacggcggcgggatcgtggccacctccctgatcgtcgcgggctacatagccgcgctgggagcaggcgccttgctgatcaagccgctacttgcacacgcggccatcgcgttcatcgccgtggaggcggtgctgggcatcatcggcg

SEQ ID NO: 465 - DNA, 288 bp, Mycobacterium tuberculosis
  modified_base (22): a, t, c or g
tgtcaagtcctttcagatctcntttttatgacatgactggagatctgtctagattgcagctcctgtgagcgtgggtaccggattcaagccggtcggtcacgccgcggtggtaccggctttgcggcagtgctcggcctcgagttcggcgatcgcgcgcgaagtgcgttcgcgcagcaagatcgcggccgtaatgccggcgatgaccgcgatgaccagcgcgatccaggagaaccgttccaaccagtgctgggcggccatcccggcgaagtagaccagtgcagtggtgcc

SEQ ID NO: 466 - DNA, 224 bp, Mycobacterium tuberculosis
  modified_base (73): a, t, c or g
  modified_base (129): a, t, c or g
  modified_base (136): a, t, c or g
  modified_base (203): a, t, c or g
caatactcaagcttcaaaacaggcctgttgtgggcgcacccggctcgccgagttctgcacgcaccgcctcaantgcggcccgcaccgccggcatctcccggtcacgcagggccgcggcccgcgccgcancgacggngtgttcgcgcagttcgccgtcaatgatgctgacctgatcggccacccgggcgttctcggcgtcgtcncgttcactaatcgcggtgctc

SEQ ID NO: 467 - DNA, 320 bp, Mycobacterium tuberculosis
  modified_base (24)..(25): a, t, c or g
tacgctggcgctggagggagccanntacaacatccacgccaatgctcttgccccgatcgcggcgaccaggatgacccaggacatcctgccgcccgaagtactggaaaagctcacacccgagttcgtcgcaccggtggtggcctacctgtgcaccgaggagtgtgccgacaacgcatcggtgtacgtcgtcggtggtggcaaggtgcagcgagttgcgctgtttggcaacgacggcgccaacttcgacaaaccgccgtcggtacaagatgttgcggcgcggtgggccgagatcaccgatctgtccggtgcgaaaattgctg

SEQ ID NO: 468 - DNA, 303 bp, Mycobacterium tuberculosis
  modified_base (17)..(18): a, t, c or g
  modified_base (45): a, t, c or g
  modified_base (103): a, t, c or g
  modified_base (163): a, t, c or g
  modified_base (171)..(173): a, t, c or g
  modified_base (226): a, t, c or g
  modified_base (295): a, t, c or g
gcttttcccgtccgtcnncgctcaaccgcgtgaggccgaagcggntggttacgactccctgtttgtgatggaccacttctaccaactgcccatgttggggacncccgaccagccgatgctggaggcctacacggcccttggtgcgctggccacggcgaccgancggctgcnnntgggcgcgttggtgaccggcaatacctaccgcagcccgaccctgctggcaaanatcatcaccacgctcgacgtggttagcgccggtcgagcgatcctcggcattggagccggttggtttganctggaaca

SEQ ID NO: 469 - DNA, 391 bp, Mycobacterium tuberculosis
  modified_base (2): a, t, c or g
  modified_base (12): a, t, c or g
  modified_base (29): a, t, c or g
cngctttttaatggccttgacntgggcgngccggccaccggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacggcgacccggcctatg

SEQ ID NO: 470 - DNA, 343 bp, Mycobacterium tuberculosis
  modified_base (48): a, t, c or g
  modified_base (77): a, t, c or g
  modified_base (269): a, t, c or g
  modified_base (275): a, t, c or g
  modified_base (311): a, t, c or g
ctcaagcttgccgggagggtgcatggccgactcggatttacccaccanggggcgccaacgcggtgtccgcgccgtcnagctgaacgttgctgcccgcctggagaacctggcgctgctgcgcaccctggtcggcgccatcggcaccttcgaggacctggatttcgacgccgtggccgacctgaggttggcggtggacgaggtgtgcacccggttgattcgctcggccttgccggatgccaccctgcgcctggtggtcgatccgcgaaaanacgaanttgtggtggaggcttctgctgcctgcgacacccacnacgtggtggcaccgggcagctttagctggcat

SEQ ID NO: 471 - DNA, 303 bp, Mycobacterium tuberculosis
ccgacgccgtcgtggccaccaacaccgcgaccagcaccgtgacccggaccggggtgccgcgcgaaccggtcttggccaattgccgcggcaccaagccgtcgcgcgccatggcgaacagcacgcggcattgcccgagcatcaacaccatcaccaccgtggtaagcccggccagcgcgccgacggagatgatgccgctggcccagtacaccccgttggcctggaacgcggtggccagatttgccggcccgcggcccggtacggtccgcagttgggtgtatggaaccatgcccgacagcaccaccg

SEQ ID NO: 472 - DNA, 264 bp, Mycobacterium tuberculosis
  modified_base (3): a, t, c or g
  modified_base (177): a, t, c or g
ttnactggcctttggtccacactagacaatactcaagcttccaggacatcgtcatcgcgaccaaaaccgcgagctaggtcggcatccgggaagcatcgcgacaccgtggcgccgagcgccgctgccggcaggccgattaggcgggcaaattagcccgccgcggctcccggctccgantacggcgccccgaatggcgtcaccggctggtaaccacgcttgcgcgcctgggcggcggcctgccggatcaggtggtaaatgccgaca

SEQ ID NO: 473 - DNA, 280 bp, Mycobacterium tuberculosis
  modified_base (1): a, t, c or g
ngacgtcttccatccgcgcgtcgttttggcgggttggccacagcagcccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtcgagcgccgttaccta

SEQ ID NO: 474 - DNA, 153 bp, Mycobacterium tuberculosis
  modified_base (17): a, t, c or g
  modified_base (23): a, t, c or g
  modified_base (52): a, t, c or g
  modified_base (112): a, t, c or g
  modified_base (143): a, t, c or g
cttcctcctgagtaccncccgtntactttgggatgggtaaaaaggcgaatcnccgtttggtcacgaacgccgggagggacaatctcgggcggctggggcctctcgcgggaangcccgaatgtacggtgtctcgacacttcccntccccctccg

SEQ ID NO: 475 - DNA, 247 bp, Mycobacterium tuberculosis
  modified_base (13): a, t, c or g
  modified_base (77): a, t, c or g
  modified_base (155): a, t, c or g
  modified_base (161): a, t, c or g
  modified_base (218): a, t, c or g
  modified_base (233): a, t, c or g
gagcatcgggacntacggagtcaactacccggccaacggtgatttcttggccgccgctgacggcgcgaacgacgccngcgaccacattcagcagatggccagcgcgtgccgggccacgaggttggtgctcggcggctactcccagggtgcggccntgatcnacatcgtcaccgccgcaccactgcccggcctcgggttcacgcagccgttgccgcccncagcggacgatcacntcgccgcgatcgcc

SEQ ID NO: 476 - DNA, 264 bp, Mycobacterium tuberculosis
  modified_base (10): a, t, c or g
  modified_base (24)..(25): a, t, c or g
  modified_base (123): a, t, c or g
  modified_base (262): a, t, c or g
tactcatgancatcctttaatcanngctttgcgtttttttattaaatcttgcaatttactgcaaagcaacaacaaaatcgcaaagtcatcaaaaaaccgcaaagttgtttaaaataagagcancactacaaaaggagataagaagagcacatacctcagtcacttattatcactagcgctcgccgcagccgtgtaaccgagcatagcgagcgaactggcgaggaagcaaagaagaactgttctgtcagatagctcttacgcnca

SEQ ID NO: 477 - DNA, 264 bp, Mycobacterium tuberculosis
  modified_base (23): a, t, c or g
  modified_base (64): a, t, c or g
  modified_base (67): a, t, c or g
  modified_base (112): a, t, c or g
  modified_base (135): a, t, c or g
  modified_base (137): a, t, c or g
  modified_base (176): a, t, c or g
  modified_base (178): a, t, c or g
  modified_base (184): a, t, c or g
  modified_base (205): a, t, c or g
  modified_base (231): a, t, c or g
  modified_base (263): a, t, c or g
ctcaagcttcaggtcaatgtgcnccaagccctgacgctggccgaccaggccaccgccgccgganacnctgccaaggccaccgaatacaacaacgccgccgaggcgttcgcancccagctggtgaccgccgagcanancgtcaaaaacctcaagacgctgcatgaccaggcgcttancnccgcanctcaggccaagaaggccgtcnaacgaaatgcgatggtgctgcaccanaagatcgccgagcgaaccaagctgctcagccng

SEQ ID NO: 478 - DNA, 352 bp, Mycobacterium tuberculosis
  modified_base (62): a, t, c or g
catggtggcactgtagcgacgtgctgcaatcaaggtcatgcccgactctggtcagctcgganccgctgacaccccgctaaggctgctcagctcggtgcattacctcaccgacggcgaactcccccagctttacgactatccggatgacggcacctggttgcgggcgaacttcatcatcagcttggacggcggcgctaccgtcgatggcaccagcggggcgatggccgggcccggcgaccgattcgtcttcaacctgttgcgtgaacttgccgacgtcatcgtggtcggcgtgggcaccgtgcgcattgagggctactccggcgtccggatgggtgtcgtccagcgccagcac

SEQ ID NO: 479 - DNA, 207 bp, Mycobacterium tuberculosis
  modified_base (57): a, t, c or g
  modified_base (88): a, t, c or g
  modified_base (133): a, t, c or g
  modified_base (181): a, t, c or g
tactcaagcttgcgggtgatcgccttggtcaacggcaccgtgatcggatcggggtcnaccgcacaaatggactggagcttcggcgaantcatcgcctatgcctcgcggggggtgacgctgaccccgggtgacntgttcggctcgggcacggtgcccacctgcacgctcgtctatcacctcnggccaccggaatcattcccgggctgg

SEQ ID NO: 480 - DNA, 256 bp, Mycobacterium tuberculosis
  modified_base (6): a, t, c or g
gttggngcctcgtcggcgaacagttctcgcacgatttccggattagcgggactggtcaccagttgggtatgcgggaaggcgctgacgttcgccgcgattagctgtttgatggacgcggtggtgatgttctgatcacggaactggctgtaatagcccagggtcgccacgctttcatccgggcccggacccggcgcaccgagcgtgtcgcgcaggtatgcgacgtgattttcgctgaagtccccgtacccggagaact

SEQ ID NO: 481 - DNA, 397 bp, Mycobacterium tuberculosis
  modified_base (34): a, t, c or g
tgcttccggctcgtatgttgtgtggaattgtgancggataacaatttcacacaggaaacagctatgaccatgattacgccaagctatttaggtgacactatagaatactcaagctccaggtcaatgtgcgccaagccctgacgctggccgaccaggccaccgccgccggagacgctgcctttgtcaccgaatacaacaacgccgccgaggcgttcgcagcccagctggtgaccgccgagcagagcgtcgaagacctcaagacgctgcatgaccaggcgcttagcgccgcagctcaggccaagaatgccgtcgaacgaaatgcgatggtgctgcggcataagatcgccgagcgaaccaagctgctcagccagctcgagcaggcgaagatgcacgagca

SEQ ID NO: 482 - DNA, 379 bp, Mycobacterium tuberculosis
caggcatgcaagcttcggaggcagacccgtgcatggtggcactgtagcgacgtgctgcaatcaaggtcatgcccgactctggtcagctcggagccgctgacaccccgctaaggctgctcagctcggtgcattacctcaccgacggcgaactcccccagctttacgactatccggatgacggcacctggttgcgggcgaacttcatcagcagcttggacggcggcgctaccgtcgatggcaccagcggggcgatggccgggcccggcgaccgattcgtcttcaacctgttgcgtgaacttgccgacgtcatcgtggtcggcgtgggcaccgtgcgcattgaaggctactccggcgtccggatgggtgtcgtccatcgcca

SEQ ID NO: 483 - DNA, 264 bp, Mycobacterium tuberculosis
  modified_base (125): a, t, c or g
  modified_base (216): a, t, c or g
  modified_base (230): a, t, c or g
  modified_base (244): a, t, c or g
tactcaagcttggggtggcgctgtcggtcggtgtgcttggcggcgtcggtatcaacaccgcccacgaaatggggcacaagaaggattcgctggagcggtggctgtccaaaatcaccctcgcccanacctgctacgggcacttctacatcgagcacaaccgtggccatcacgtccgggtgtccacaccggaggacccggcgtcggcgcggttcggcnaaacgttgtggganttcctgccccgcantgttatcggcggcttgcgct

SEQ ID NO: 484 - DNA, 351 bp, Mycobacterium tuberculosis
  modified_base (16): a, t, c or g
  modified_base (256): a, t, c or g
ggccatcgccaccgcnccgcggcgaacgctcaaaggcacctactggcaccaaggccccacacgtcaccctgtgacctcctgcgccgaccccgcccgaggtcctggccgttaccaccgaacgggcgagccgggagtctggtacgcatcgaacaaagagcaaggtgcatgggcggagttgttccgccacttcgtcgatgacggggtcgatccattcgaggtccgtcgccgcgtcggtcgagtggcggtcacactccangtactcgacctcacagacgagaggactcgatcccatctaggtgtggacgaaacagatcttctgtccgacgactacaccaccacccaggccatcgc

SEQ ID NO: 485 - DNA, 328 bp, Mycobacterium tuberculosis
  modified_base (50): a, t, c or g
  modified_base (56): a, t, c or g
  modified_base (70): a, t, c or g
  modified_base (81): a, t, c or g
  modified_base (84): a, t, c or g
  modified_base (126): a, t, c or g
  modified_base (174): a, t, c or g
  modified_base (207): a, t, c or g
  modified_base (216): a, t, c or g
  modified_base (222): a, t, c or g
  modified_base (246): a, t, c or g
  modified_base (253): a, t, c or g
  modified_base (271): a, t, c or g
  modified_base (315): a, t, c or g
gcttgcgggtgatcgccttggtcaacggcaccgtgatcggatcggggtcnaccgcncagatggactggancttcggcgaantcntcgcctatgcctcgcggggggtgaccctgaccccgggtgacntgttcggctcgggcacggtgcccacctgcacgctcgtcaagcacctcnggccaccggaatcattcccgggctggctgcacnacggcgacntggtcnccctccaggtcgaagggctgggcnaaacaangcagaccgtccggacaancggcactccttttccgttggctcttcggccgaatccggacgccnaacccgaccggcg

SEQ ID NO: 486 - DNA, 344 bp, Mycobacterium tuberculosis
  modified_base (106): a, t, c or g
  modified_base (131): a, t, c or g
  modified_base (144): a, t, c or g
  modified_base (265)..(266): a, t, c or g
  modified_base (309): a, t, c or g
gttctcgcacgatttccggattagcgggactggtcaccagttgggtatgcgggaaggcgctgacgttcgccgcgattagctgtttgatggacgcggtggtgatgtnctgatcacggaactggctgtaatancccagggtcgccncgctttcatccgggcccggacccggcgcaccgagcgtgtcgcgcaggtatgcgacgtgattttcgctgaagtccccgtacccggagaactcgaacacgctgaggcgctcgtcaccgtcgtnncggcgaccaagcgcggcgagcaactgcgcaaaatcgttaaganaggtcgaatcgttgaaattcggcaccacctgcacc

SEQ ID NO: 487 - DNA, 285 bp, Mycobacterium tuberculosis
  modified_base (35): a, t, c or g
  modified_base (76): a, t, c or g
  modified_base (147): a, t, c or g
  modified_base (149): a, t, c or g
  modified_base (154): a, t, c or g
  modified_base (188): a, t, c or g
  modified_base (193): a, t, c or g
  modified_base (243): a, t, c or g
  modified_base (246): a, t, c or g
  modified_base (255): a, t, c or g
cacaagacaatactcaagcttcaggtcaatgtgcnccaagccctgacgctggccgaccaggccaccgccgccgganacgctgccaaggccaccgaatacaacaacgccgccgaggcgttcgcagcccagctggtgaccgccgagcanancgtcnaaaacctcaagacgctgcatgaccaggcgcttancgccncagctcaggccaagaaggccgtcgaacgaaatgcgatggtgctgcagcanaanatcgccgancgaaccaagctgctcagccagctcgagcag

SEQ ID NO: 488 - DNA, 280 bp, Mycobacterium tuberculosis
ccacccgtgcatggtggcactgtagcgacgtgctgcaatcaaggtcatgcccgactctggtcagctcggagccgctgacaccccgctaaggctgctcagctcggtgcattacctcaccgacggcgaactcccccagctttacgactatccggatgacggcacctggttgcgggcgaacttcatcagcagcttggacggcggcgctaccgtcgatggcaccagcggggcgatggccgggcccggcgaccgattcgtcttcaacctgttgcgtgaacttgcc

SEQ ID NO: 489 - DNA, 160 bp, Mycobacterium tuberculosis
  modified_base (18): a, t, c or g
  modified_base (117): a, t, c or g
  modified_base (137): a, t, c or g
  modified_base (148): a, t, c or g
gctttccgccgatacccnccatgtcccgcacatccaggacttctggggggatccgctgacagcggcgggatcccaaagtgcggatgatcgggccgcctacgtcgtggtgtacctcgncggtaacaacgaaaccgaancgtatgactcngtccacgcggtg

SEQ ID NO: 490 - DNA, 176 bp, Mycobacterium tuberculosis
  modified_base (25): a, t, c or g
  modified_base (131): a, t, c or g
  modified_base (138): a, t, c or g
  modified_base (140): a, t, c or g
  modified_base (151): a, t, c or g
  modified_base (169): a, t, c or g
caacccganttggctttcggcgccntcggtgaggacggcgtgcgggtgctcaacgacgacgtcgtccgcgggacacacctcgatgctgccgccatggacgcggtcgaacgcaagcagctgatcgatctacnacgccgngnggaacgcttcngccgcgggcgtgaccgcntcccgtt

SEQ ID NO: 491 - DNA, 216 bp, Mycobacterium tuberculosis
gggatgggcaaaaaggcgaagcaccgcgtggccacgaacgccgggagggacaatctcgggcggctagggcttctcgcgggaaggcccgaacgtacggcgtttcaacacgtcgcgtcgccctccgaccgcgaacattcggggatggcagcaacctggtagcaccctggccgggcgatgatctgccagcgtccccgcgggtagtcgccgcccgggcgg

SEQ ID NO: 492 - DNA, 163 bp, Mycobacterium tuberculosis
cagcagaccaacaagagcatcgggacatacggagtcaactacccggccaacggtgatttcttggccgccgctgacggcgcgaacgacgccagcgaccacattcagcagatggccagcgcgtgccgggccacgaggttggtgctcggcggctactcccacggtt

SEQ ID NO: 493 - DNA, 80 bp, Mycobacterium tuberculosis
ctcaagcttgactggccacccaccggcatgaccaccgacaggcccgactggtcgtaccactcgaacgccggggtgtttga

SEQ ID NO: 494 - DNA, 248 bp, Mycobacterium tuberculosis
  modified_base (30): a, t, c or g
  modified_base (186)..(189): a, t, c or g
ttggtgcccggaatggcgagtcccatttantcgctgatttgtttgaacagcgacgaaaccggtgttgaaaatgtcgcctgggtcggggattccctctccaagcaagagtaactggccccaaataaagttactcgtcgtcttgcaaagaccgctacccgatgccatttatgtgtttccttacgctcnnnnttccggtgcgccatcattatctgcacctttgcactgcacattgagcttagcagcgctcg

SEQ ID NO: 495 - DNA, 341 bp, Mycobacterium tuberculosis
  modified_base (6): a, t, c or g
  modified_base (187): a, t, c or g
gaattngctttcggcgccatcggcccaggaccgcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcngtgatcgtcgatgacggcatcgccaccggagcgacggccaaggcggcgtgccaggtcgcccgggcgcacggtgcggacaaggtggtgctggcggtcccgatcggcccagacgacatcgtggcgagattcgccgggtacgccgatgaagtggtgt

SEQ ID NO: 496 - DNA, 420 bp, Mycobacterium tuberculosis
  modified_base (21): a, t, c or g
  modified_base (23): a, t, c or g
  modified_base (106): a, t, c or g
  modified_base (200): a, t, c or g
  modified_base (272): a, t, c or g
  modified_base (355): a, t, c or g
  modified_base (362): a, t, c or g
  modified_base (413): a, t, c or g
taaagctttcgtcagttcatngngcccccggaccaacaaaagcatcgggacatacggagtcaactacccggccaacggtgatttcttggccgccgctgacggcgcnaacgacgccagcgaccacattcagcagatggccagcgcgtgccgggccacgaggttggtgctcggcggctactcccagggtgcggccgtgatcnacatcgtcaccgccgcaccactgcccggcctcgggttcacgcagccgttgccgcccgcagcggacgatcacntcgccgcgatcgccctgttcgggaatccctcgggccgcgctggcgggctgatgagcgccctgacccctcaattcgggtccaanaccatcnacctctgcaacaacggcgacccgatttgttcggacggcaaccggtggcgancgcacct

SEQ ID NO: 497 - DNA, 135 bp, Mycobacterium tuberculosis
  modified_base (16): a, t, c or g
  modified_base (26): a, t, c or g
  modified_base (50)..(51): a, t, c or g
  modified_base (54)..(56): a, t, c or g
  modified_base (64): a, t, c or g
  modified_base (67): a, t, c or g
  modified_base (108)..(109): a, t, c or g
  modified_base (113): a, t, c or g
  modified_base (119): a, t, c or g
  modified_base (127): a, t, c or g
ccgggagggaccatcncgggcggctncggcttctctccggaaggttctanngtnnngcgtttcnacncttcccgtcgccctgcgaccgccgaacattcggggtatggnngcancctgtnagcatccnggccgggc

SEQ ID NO: 498 - DNA, 277 bp, Mycobacterium tuberculosis
  modified_base (103): a, t, c or g
  modified_base (254): a, t, c or g
ctcaagcttccgcatcagatcgctatagaaccggtgcgcgtccccaccgagtggctggtcgccttccagcacgatcgttaccgcgttatcggaatcaaactcnccgaacacctgaccaacgcgcttgatcgcctgaatcgatgcggcgtcgctggggctcatcgataccgagtgtgcttttccgaccacttccagttgcggtacggcgagattgacaaaggcggtgaagcccagccagagcaggacgatcaccnccgcaaaccggcggatttgcccg

SEQ ID NO: 499 - DNA, 323 bp, Mycobacterium tuberculosis
  modified_base (28): a, t, c or g
  modified_base (188): a, t, c or g
  modified_base (193)..(194): a, t, c or g
  modified_base (311): a, t, c or g
  modified_base (323): a, t, c or g
gcttggcagcctgcggctgggcgccctngagctcttcgatctggatctccggactcgagatgctcacttgcccggccgtggacgtacccattgcggccgggaccccagcgccccaggtgaccagcgagttgggctgcacgctgaccggcccgtcggggtcgacgccggtaacggtcagcagctccgangtccnnctgatcccgaccgcagctgccaatgcgcggctggcagccgacgtggatgtgccggggcctagatcgcggggcagcagcgagaccgcgtcaccgacggtcatcaccttgccgagtttnggcctgccgcan

SEQ ID NO: 500 - DNA, 148 bp, Mycobacterium tuberculosis
  modified_base (46): a, t, c or g
gcttccggctcgtatgttgtgtggaattgtgagcggataacaattncacacaggaaacagctatgaccatgattacgccaagctatctaggtgacactatagaatactcaagcttgagccatcgggctatcagctggttgatgtcccg

SEQ ID NO: 501 - DNA, 242 bp, Mycobacterium tuberculosis
caggcatgcaagcttgtcgtctatcacatccgaccaccaaccgcccgacggctcggcagaacgcctccgcatatgggtcgacgaccagcgggtcggacttctgggctgccagcgctcgcgccgtcgcgacaaacagcgcggtcgaaccgacactccttgtgatgtcccacctatcaccttcggtacgcacccaatcgaccctacgcggctagctcagccccgatcttccagagctccgcccg

SEQ ID NO: 502 - DNA, 230 bp, Mycobacterium tuberculosis
  modified_base (122): a, t, c or g
gctttttgagcgtcgcgcggggcggcttccccggcaattctactagcgagaagtctggcccgatacggatctgaccgaagtcgctgcggtgcagcccaccctcattggcgatggcgccgacnatggcgcctggaccgatcttgtgccgcttgccgacggcgacgcggtaggtggtcaattccggtctacgcttgggcctttgcggacggtcccgacgctggtcgcggttg

SEQ ID NO: 503 - DNA, 235 bp, Mycobacterium tuberculosis
  modified_base (4): a, t, c or g
  modified_base (36): a, t, c or g
cgancctgttcgacggctacctgaatcaccccgatnccaccgccgcggcgttcgacgccgacagctggtaccgcaccggcgacgtcgcggtggtcgacggcagtgggatgcaccgcatcgtgggacgcgagtcggtcgacttgatcaagtcgggtggataccgggtcggcgccggtgaaattgaaacggtgctgctcgggcatccggacgtggcggaggcggcagtcgtcggggt

SEQ ID NO: 504 - DNA, 152 bp, Mycobacterium tuberculosis
  modified_base (1): a, t, c or g
  modified_base (26): a, t, c or g
  modified_base (32): a, t, c or g
naagctttgtcacaccaagtgtttcnaccagncgctccatccggcgaagtggatactcccagcaggtagcaggtcgccaccacgctggtcagtgcgcgttcagctcgcttgcggcgctgcagcagccagtccgggaaatagctgccctggcg

SEQ ID NO: 505 - DNA, 192 bp, Mycobacterium tuberculosis
  modified_base (7): a, t, c or g
cgctggncgccggcgctgggctgcggtaaccaattaccacaacacttttcggtagccgaacagcggcgcgtaccagcgaaatggcacagccaccgcagtcgccgacatcccgcgaagatgtggcagattttcgtgcggtcgagccggcgaaggcctagcgtcattgttgcctggcaaggttgctgggcccgg

SEQ ID NO: 506 - DNA, 312 bp, Mycobacterium tuberculosis
  modified_base (28): a, t, c or g
  modified_base (34): a, t, c or g
  modified_base (142): a, t, c or g
  modified_base (166): a, t, c or g
  modified_base (169): a, t, c or g
  modified_base (189): a, t, c or g
ctcaagcttcttctgccccttgccgttncggatnacatcccgcagcgactcggcttcggcgtcgatgtcgaagttctcgatcagcttctggatcgactccgcgcccatggcaccggtgaagtactcgccgtagcggtcgacnagttcgcggtagaggttttcgtcnacnatcagctgcttgggcgccancttggtgaaagtgctccaaatgtcctccaaccggtccagctcacgctgcgcgcggtcacggatctggcgcatctcgcgctcgccgccgtcgcgaacttgcgccgcgcatcggccttggggccc

SEQ ID NO: 507 - DNA, 296 bp, Mycobacterium tuberculosis
  modified_base (23): a, t, c or g
  modified_base (30): a, t, c or g
  modified_base (184): a, t, c or g
  modified_base (186): a, t, c or g
  modified_base (189): a, t, c or g
  modified_base (275): a, t, c or g
gttcacacctacctactatgccncaattcnccgacacgggtggcatcaacacgggcgataaggtggaaatcgctggggtgaacgtcgggctggtgcgctcgctggcaatccgcggcaaccgcgtgttgatcggattctcgttgcccggcaagacaatcgggatgcaaagccgggcagcaattcncnccnacaccattcttggccgtaagaacctggagatcgaaccccgcggttcggagccgttgaaacccaacggtttcctgccgttggcgcanaccactacgccataccaaatc

SEQ ID NO: 508 - DNA, 208 bp, Mycobacterium tuberculosis
ctcaagctttacgccgacgccggcctacacaacaccaaggaaacgattgcctactgccgaatcggggaacggtcctcgcacacctggttcgtgttgcgggaattactcggacaccaaaacgtcaagaactacgacggcagttggacagaatacggctccctggtgggcgccccgatcgagttgggaagctgatatgtgctctggaccc

SEQ ID NO: 509 - DNA, 278 bp, Mycobacterium tuberculosis
  modified_base (5): a, t, c or g
  modified_base (30): a, t, c or g
tcccncatgggataacgggtttagatttcnacaacggcaccgtgtttctcaacaagccggtcatcagctgggccggcgacaacggtatctacttcacccgctttcgcccgtacaagaaaaaccactaggccaccatcgagtccaagaacaaccacctggtccgcaagtacgcgttctactaccgctatgacaccgccgaggaacgcgccgtgctcaaccggatgtggaagctggtcaacgaccgcctcaactacctcaccccgaccatcaaaccgatc

SEQ ID NO: 510 - DNA, 177 bp, Mycobacterium tuberculosis
  modified_base (34): a, t, c or g
  modified_base (158): a, t, c or g
  modified_base (166): a, t, c or g
ctcaagcttgggtgttgccgatcaccggaagccncatgatcagccacgtttcgcgccgcccggcatacggcggcgtaccgatctccgcgtcatacacccgcgggtaatcgccgacggtgccggttcgcgagccgaaggtgacaacgctgattgaatcnagttccangtccagcgggt

SEQ ID NO: 511 - DNA, 296 bp, Mycobacterium tuberculosis
  modified_base (2): a, t, c or g
  modified_base (104): a, t, c or g
  modified_base (184)..(187): a, t, c or g
  modified_base (206): a, t, c or g
  modified_base (226): a, t, c or g
  modified_base (250): a, t, c or g
  modified_base (283): a, t, c or g
tnaacagctcgcggcagcccacgacctgctgcgtcggattgccggcggcgagatcaattccaggcagctcccggacaatgcggctctgctggcccgcaacgaangactcgaggtcaccccggtgcccggggtcgtggtgcacctgccgatcgcacaggttggcccacaaccggccgcttgatgnnnngtcggcaagcccggcagtngccaaacccagcgtgatcangctcggctcgcgagttcggcgaanaagtggctcgcctgatcacctaccatcggccangatctgcgtgtca

SEQ ID NO: 512 - DNA, 223 bp, Mycobacterium tuberculosis
  modified_base (5): a, t, c or g
  modified_base (30): a, t, c or g
  modified_base (145): a, t, c or g
  modified_base (148): a, t, c or g
  modified_base (160): a, t, c or g
  modified_base (223): a, t, c or g
gccanccggcttggcgtcgactcccgttcngcacatcatacggtccccggtactgtccaactgcgccggtgcgctagccaaacgtcacgactctcagtgatcccagttcgtgatccggccggtggcgccgctgcggcgggggctnatntacttcggactnattatctcatccaaaggacaccgggccggtggctggaatcccatggtgcgatcggccacacan

SEQ ID NO: 513 - DNA, 147 bp, Mycobacterium tuberculosis
  modified_base (103): a, t, c or g
ccgacctggtatcttccgatagcgcgcgttgatatccggtctgatctcctgcccttaacgccggatctcagcaggtccccatgcaaagatccgaggtgtcccngatctaggggtcctcgtcctccagatgatggagcaagtcggccc

SEQ ID NO: 514 - DNA, 149 bp, Mycobacterium tuberculosis
ctcaagcttcggctcaggcggcgctgccggtaacgtcgctgaccggtgcaggtttcgacaatgtggtgccggttcggcggctacgtgccatcaagacactggcgcaggctatcgcacccgttatcggctacaaacaaatcgcggtatgc

SEQ ID NO: 515 - DNA, 238 bp, Mycobacterium tuberculosis
  modified_base (10): a, t, c or g
catcacctgnttcatgaactggaagcaccgcagcgcttccttttcggccgcaacatgagccagcctctcgtcggcggtcgggtgcaggtgctcgggcagctcggccgcgacagccgcctgaccctgaaaccagcttccatatcccgcgacgaacgacgccagtccgctacgtaacccctccgcgactgtccatggacaacagcgcgttctccaccgaccgggcccgggtgtggggtgt

SEQ ID NO: 516 - DNA, 175 bp, Mycobacterium tuberculosis
agcttagcttcccgccccggcaatagggctccagctcatccggtgtgaccagataggggcccagggtgataccgctgtctttgcccttggcctgtccgatgcgcagctggccctccagcatctgcaggtcccgtgcggaccagtcgttgaaaatggtatagccgatgatcgaccg

SEQ ID NO: 517 - DNA, 144 bp, Mycobacterium tuberculosis
  modified_base (3): a, t, c or g
  modified_base (16): a, t, c or g
ccngaacagaagcggnggttcctaccgcggtgtgcggccggcgcgatatcggcctttttactaaccgaacccgatgtgggctccgatccggcgcgcatggcatcgacggcgacgccgatcgatgaccgccaggcttaccacctt

SEQ ID NO: 518 - DNA, 174 bp, Mycobacterium tuberculosis
ctcaagcttgcgcgactcgacaagcattcttgacagttgttttggctcggcatggttagccaaggttctgcggtcccaccagatcatcttggtccggtagcgctcgtccgggtatgctgccgccgggattctcgctgctattactccccccgaagaacgccaccggtccagcgc

SEQ ID NO: 519 - DNA, 187 bp, Mycobacterium tuberculosis
  modified_base (3): a, t, c or g
gcnaggcggtatagcttcccgtcgtaccggcgaccgccagccgagaagctcgttttcccagtgttgctggggattctcacgctgctgctgagtgcgtgccagaccgcttccgcttcgggttacaacgagccgcggggctacgatcgtgcgacgctgaagttggtgttctccatggacttggggatgt

SEQ ID NO: 520 - DNA, 215 bp, Mycobacterium tuberculosis
  modified_base (45): a, t, c or g
gtgtggaaccgtgagcggataacaatttcacacaggaaacagctntgaccttgattacgccaagctatttaggtgaggctatattaatactcaagattgcggtcgagcacatcggcccaagaaccgccgaaggcacggcggaacgcctgcggcacatggggcgacgaccagcgggtcggacttctgggctgtccagccggatcgcgccgtcgcga

SEQ ID NO: 521 - DNA, 406 bp, Mycobacterium tuberculosis
cactgtcagtacatatgcgccgctcctcctcatcgctgcgctcggcatcgtcgccggcggtcatggcgtcaccctacccaagccgaacgcgaaacgagaacgtgttccattattagggtgtgagcaccaataccagattgctcaccaggaactcacgcagcaccgggacggatgtcagccaccacgcccatctggggtggtagcggggaaatacggctaacgcggctccggtgccggcagcccagcgcagaccctcggcggcggacacggcaaacaacgacgacccatagttgttctttgccggatggccgtgtttgcggacatatcgggcggcggcgcgggcgccgccgaggtagtggctgaggcccatctcgtgcccgccgaatggccccagccaaaccgtgta

SEQ ID NO: 522 - DNA, 180 bp, Mycobacterium tuberculosis
  modified_base (86): a, t, c or g
  modified_base (174): a, t, c or g
ctcaagcttttacggtgatcgcgcatcacctggttcatgaactggaagcagcgcagcgcttccttttcggccgcaacatgagccancctctcgtcggcggtcgggtgcaggtgctcgggcagctcggccgcgacagccgcctgaccctgaaaccagcttccatatcccgcgacnaacgac

SEQ ID NO: 523 - DNA, 69 bp, Mycobacterium tuberculosis
  modified_base (47): a, t, c or g
ctcagaagccgctagctggtagagtcgctgaccggtgcacgtggcgncaatgtgcgctgccggttcgcg

SEQ ID NO: 524 - DNA, 168 bp, Mycobacterium tuberculosis
  modified_base (111): a, t, c or g
  modified_base (114): a, t, c or g
  modified_base (157): a, t, c or g
ctcaagcttgcgctcatcaagcgcgaacagcagggcggtcggctggtcgccatgacgggtgacgggaccaatgacgcacccgcgctcgcgcaagccgatgtcggggtggcnatnaataccggcacccaggcggcccgggaagccggcaacatggtcnatctccactcc

SEQ ID NO: 525 - DNA, 83 bp, Mycobacterium tuberculosis
  modified_base (73): a, t, c or g
acttctatttcgactggtgtgctgtggcgcgatccgactgccggcgtggtcaaggccggccagttgtgggatnccacaggcac

SEQ ID NO: 526 - DNA, 173 bp, Mycobacterium tuberculosis
gcttgtcgtattccgtggcactgtcagacatatgcgccgctcctcctcatcgctgcgctcggcatcgtcgccggcggtcatggcgtcaccctacccaagccgaacgcgaaacgagaacgtgttccattattagggtgtgagcaccaataccagattgctcaccaggaactcac

SEQ ID NO: 527 - DNA, 38 bp, Mycobacterium tuberculosis
cgatattcgtcggccgcgttgtctcgactgggtcgcgt

SEQ ID NO: 528 - DNA, 136 bp, Mycobacterium tuberculosis
  modified_base (96): a, t, c or g
  modified_base (136): a, t, c or g
gacctcggccaccaagccggacgcgaccgtcgaggtggcgatccggcttggcgtcgacccgcgtaaggcagaccacatggtccgcggcacggccancctgccacacggcactggtaagactgcccgcgtcgcggcn

SEQ ID NO: 529 - DNA, 114 bp, Mycobacterium tuberculosis
ccggaagtctaggggacgacctactcagcgcaaaatgtcgctaatgtgagtccgccccaccagggcagatcaacccatgtcgatgatgacctacccggataccggattggcggt

SEQ ID NO: 530 - DNA, 119 bp, Mycobacterium tuberculosis
  modified_base (91): a, t, c or g
agcttcagttcctccacgacgcgttcccaaatgaatttcccgatcccacaatctcggttcagatacaggtcgccataccccttacttcggnaacgctgggcggattggccctgccgctg

SEQ ID NO: 531 - DNA, 99 bp, Mycobacterium tuberculosis
ccgcctacgggtcgaacatgcatcccgagaccgatgctcgagcgcgcaccccactcgccgatggccggaaccggctggttacccgggtggcggctgacc

SEQ ID NO: 532 - DNA, 308 bp, Mycobacterium tuberculosis
  modified_base (141): a, t, c or g
  modified_base (147): a, t, c or g
  modified_base (308): a, t, c or g
gcggctggttacgactccctgtttgtgatggaccacttctaccaactgcccatgttggggacgcccgaccagccgatgctggaggcctacacggcccttggtgcgctggccacggcgaccgagcggctgcaactgggcgcnttggtnaccggcaatacctaccgcagcccgaccctgctggcaaagatcatcaccacgctcgacgtggttagcgccggtcgagcgatcctcggcattggagccggttggtttgagctggaacaccgccagctcggcttcgagttcggcactttcagtgaccggttcan

SEQ ID NO: 533 - DNA, 328 bp, Mycobacterium tuberculosis
  modified_base (31): a, t, c or g
  modified_base (185): a, t, c or g
  modified_base (187)..(188): a, t, c or g
gcctttccgcacaatctgtaccccaggaccntctaaaaaatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccantnntgtcggtcccacgatgacccagtactacatcattcgcacggagaacctgccgctgctagagccactgcgatcggtgccgatcgtggggaacccactggcgaacctggttcaaccaaacttgaaggtgattgttaacctgg

SEQ ID NO: 534 - DNA, 75 bp, Mycobacterium tuberculosis
gcagaccaacaagatgcatcgggatcatacgccgtcaactacccggccaacggtgatttcttggccgccgcccac

SEQ ID NO: 535 - DNA, 319 bp, Mycobacterium tuberculosis
  modified_base (35): a, t, c or g
  modified_base (49): a, t, c or g
  modified_base (88): a, t, c or g
  modified_base (93): a, t, c or g
  modified_base (135): a, t, c or g
  modified_base (228): a, t, c or g
  modified_base (299): a, t, c or g
ctcaagcttgccaaagagacctcgtccaccaagcnggacgcgaccgtcnaggtggcgatccggcttggcgtccacccgcgtaaggcanaccanatggttcgcggcacggtcaacctgccacacggcactggtaanactgcccgcgtcgcggtattcgcggttggtgaaaaggccgatgctgccgttgccgcgggggcggatgttgtcgggagtgacaatctgatcganaggattcagggcggctggctggaattcgatgccgcgatcgcgacaccggatcagatggccaaagtcggtcncatcgctcgggtgctgggtc

SEQ ID NO: 536 - DNA, 312 bp, Mycobacterium tuberculosis
  modified_base (185): a, t, c or g
ccacggcgtggatcaaggtaccggccgggatgttgcgcaatggcaggttgttgcccggcttgatgtcggcgttagcgccggattccaccacatccccttgcgaaagtccgttgggtgcaatgatgtagcgcttctccccatcgagatagtggagcaacgcaatccgtgcggtacggttcgggtcntactcgatgtgcgcgaccttggcgttgacaccatctttgtcattgcggcgaaagtcgatcatccggtaagcgcgcttatgaccgccgcctttgtgccgggtggtaatccggccatgcgcgttgcgtc

SEQ ID NO: 537 - DNA, 105 bp, Mycobacterium tuberculosis
ggcggctgcgtcggcgagatgatcgcccggtgccaccccgatccgtgcctcggtcagcgccaacgtgctttccggtccggcgaccaccatgtcgcatgcgccgac

SEQ ID NO: 538 - DNA, 144 bp, Mycobacterium tuberculosis
  modified_base (43): a, t, c or g
  modified_base (47): a, t, c or g
  modified_base (60): a, t, c or g
  modified_base (75): a, t, c or g
  modified_base (134): a, t, c or g
  modified_base (141): a, t, c or g
gcaatcgccttggcggtcgccgggttgtcaccggtgatcatcncggngcggatgctcatncggcgcatttcgtcnaatcgttcccgtatgcccaccttgacgatgtccttcatatggaccacgccgatggcccncgcgctnctg

SEQ ID NO: 539 - DNA, 431 bp, Mycobacterium tuberculosis
ccggctcgtatgttgtgtggaattgtgagcggataacaatttcacacaggaaacagctatgaccatgattacgccaagctatttaggtgacactatagaatactcaagcttccacatcggtatgccaaagcattgcgccgctatcgatttcgcgctggcatcgccaaggtggacttcttgctcagcgacgagatcccgtggtcggatccgcggctgcggcgggctgcgaccctgcatctcggcggcacccgtgaccagatggcgcgcgccgaggcagacgtcgcggcgggacgccacgccgactggccgatggtgctggccgcgtgtccgcacgtcgccgaccccggccgcatcgacgaaaccggccgccgtccgttctggacctatgcccacgtgccgtcggggtccacgctcgacgcgaccgagaccgt

SEQ ID NO: 540 - DNA, 462 bp, Mycobacterium tuberculosis
cgcgtccaccgcagcgtgagattggtggcgccattcgtcgtggtgtagctgctgttggcggcgtcgccgtattgtgcgggccagccttgtgcgggggccgcttctacccacgagtcggcacttccgcaaccgcccagctcgaccgcgattacggcggccgcaacggccgccggaaggcgtctcgcaagcgccttatcctttcgcaggttcccagatccttccgctacgtgggtcgctcatcggcgggcccggccgaatgagtacaggtgagggtaaccgctacaaatgaagttggtcagtgctggccaactgtgtaatggttgcccggctcgggtcaccacgtacattctggcaaggcgggcgagattcggttcctcgcgtccttggccggtggcggttcccggttgtccgtgggcgtgtcgtgtacgtggtgtaagtgtcgtgaactcctcagtttgggct

SEQ ID NO: 541 - DNA, 307 bp, Mycobacterium tuberculosis
  modified_base (206): a, t, c or g
  modified_base (212): a, t, c or g
  modified_base (298): a, t, c or g
ctcaagcttgcgctggatctggcggctgagcctgttcttgggcaacatgccgagggatcgccttttccaccacgcggtcggggtggcgttgcattagctcaccgatggtgcgcttgtgcaggccgccgggataccccgagtgccggtaaaccatcttgtgctgcagtttgtcgccgctgatggcgaccttgtcggcgttgatcacnatgacnaagtcaccgccatcgacattgggggcgaacgtcggcttgtgcttgccgcgcagcaggttggccgccgcgacggcaaggcggccaancaccacgtc

SEQ ID NO: 542 - DNA, 333 bp, Mycobacterium tuberculosis
  modified_base (26): a, t, c or g
tttgggatgggcaaaaaggcgaagcnccgcgtggccacgaacgccgggagggacaatctcgggcggctagggcttctcgcgggaaggcccgaacgtacggcgtttcaacacgtcgcgtcgccctccgaccgcgaacattcggggatggcagcaacctggtagcaccctggccgggcgatgatctgcagcgtcgccgcgggtagtcgccgcccgggcggctacagtctgaaacgcgatgaccatcgatgtgtggatgcagcatccgacgcaacggttcctacacggcgatatgttcgcctcgctgcgccggtggaccggtgggtctatcccgga

SEQ ID NO: 543 - DNA, 234 bp, Mycobacterium tuberculosis
  modified_base (48): a, t, c or g
  modified_base (161): a, t, c or g
  modified_base (193): a, t, c or g
  modified_base (198): a, t, c or g
  modified_base (200): a, t, c or g
  modified_base (221): a, t, c or g
ctcaagcttcgtcataagaccatggtgcgctttctttcacccgtccanagtcgggggcatccgcaccggctcgcatcgcatcatcctcccacgacgggccgctcatcagcttgggccatttcaatgtacttgataccccgcgctgcgggtaggccactgcnacaattcaaacacggtgtcacacggtgaatantgtcnanatgggctctgatcaaccgtcncaaacccggtttc

SEQ ID NO: 544 - DNA, 440 bp, Mycobacterium tuberculosis
  modified_base (427): a, t, c or g
gaattctgcgtgcaccgctatgggttgcagcagcggctggcgccgcacaccccactggcccgggtgttttcgccccgaacccggatcatggtgagcgaaaaggagattcgcctgttcgatgctgggattcgccaccgcgaggccatcgaccgattactcgccaccggggtgcgagaggtgccgcagtcccgctccgtcgacgtctccgacgatccatccggcttccgccgtcgggtggcggtagccgtcgatgaaatcgctgccggccgctaccacaaggtgattctgtcccgttgtgtcgaagtgcctttcgcgatcgactttccgttgacctaccggctggggcgtctgcacaacaccccggtgaggtcgtttttgttgcagttgggcggaatccgtgctctgggttacagccccgaactcgtcncggcggtgcgcgc

SEQ ID NO: 545 - DNA, 425 bp, Mycobacterium tuberculosis
  modified_base (30): a, t, c or g
  modified_base (57): a, t, c or g
  modified_base (111): a, t, c or g
  modified_base (180): a, t, c or g
  modified_base (185): a, t, c or g
  modified_base (197): a, t, c or g
  modified_base (288): a, t, c or g
  modified_base (356): a, t, c or g
  modified_base (359): a, t, c or g
  modified_base (385): a, t, c or g
  modified_base (402): a, t, c or g
gcagttgggaatcgctctgcagcaaaccantattctgcgcgacgttcgagaggactntttgaatggacggatctacctgccgcgcgacgagctggaccgattaggcgtacncctccgcctggacgactccggggcactcgatgaccccgacggacggctcgcggcactgctgcggttcantgccnaccgcgccgcanactggtattcgctgggactgcggctgattccacacctcgaccgccgcagcgctgcctgctgtgcggccatgtctggcatctaccgccgtcngctcgccttgatcagaccatcgccggcggtcgtctaccatcggcgaatctctctgttcgggactgaanaangcccaagtggcggcggcagcactggnctcttcggtaacctgcngaccgcccattggaccgctaccg

SEQ ID NO: 546 - DNA, 401 bp, Mycobacterium tuberculosis
  modified_base (30): a, t, c or g
  modified_base (71): a, t, c or g
  modified_base (93): a, t, c or g
  modified_base (188): a, t, c or g
  modified_base (325): a, t, c or g
ttgatctggacgtctgagacggtgatcggnccgaacctgaattgtccggtaatgcccagcgcagaaagcanggtggtggccggggcggtgaanccggcgtcggcggcaccgtcgaagtcgatgtggattgccggaatggggatgtccggcacggcgaagccgtagttcgcttgtcccgtgaggcccangtggatggggggaaggatcgtggtgtccgggatgataatggggccgatgccgccggttgaagtccagtggatcgggaattcgggaatcgtgatgccgacgttcaggccgaacaggccctccaagttgcctcgccacnagatgccgttgctgaagttgcccgacatgagggcgccggtgtccacattgcccgaattggcgacgccggtgttggc

SEQ ID NO: 547 - DNA, 391 bp, Mycobacterium tuberculosis
  modified_base (23): a, t, c or g
  modified_base (52): a, t, c or g
  modified_base (91): a, t, c or g
  modified_base (163): a, t, c or g
  modified_base (174): a, t, c or g
  modified_base (265): a, t, c or g
  modified_base (301): a, t, c or g
  modified_base (304): a, t, c or g
cacgtaggcgccgtccataaatnactccgccgcgcttcgcacatcctcgtancgatccttggcgagcaggtcaaccgggcgctgcccgtcnaggagccggtttttggcgtgcagccactggccgacacctcggggggtaagcgaatccgagagcaggaggacnaggtcacgaanctgcgccagccggtcgtaccgctcagggcggatgtcgccggtccgccacccgcgtaccgcccgatcggacacctgtatgaccgcggcgacntcgacctgggtgacgccgaagggtttcagggcatcnacnatctcgctggcctcgaccgcccggtccagggtgaccgccatcgtggttcctccgcaacttccggttctactaccgtaaacgctaccg

SEQ ID NO: 548 - DNA, 369 bp, Mycobacterium tuberculosis
  modified_base (52): a, t, c or g
  modified_base (80): a, t, c or g
  modified_base (89): a, t, c or g
  modified_base (266): a, t, c or g
  modified_base (356): a, t, c or g
cggggaacggtcctcgcacacctggttcgtgttgcgggaattactcggacancaaaacgtcaagaactacgacggcagtnggacagaanacggctccctggtgggcgccccgatcgagttgggaagctgatatgtgctctggacccaagcaaggactgacattgccggccagcgtcgacctggaaaaagaaacggtgatcaccggccgcgtagtggacggtgacggccaggccgtgggcggcgcgtttcgtgcggctgctgggacncctccgacgagttcaccgccgggaggtcgtcgcgtcggccaccgggcgaatttccggttcttcgccgcgccccgggatcctgggaccgcnggcgcgcgctgtt

SEQ ID NO: 549 - DNA, 85 bp, Mycobacterium tuberculosis
ctcaagctttgtccgacaagcgttcccgggcggtcagcaagcgaacgtcggttggcccactgcgggtcgatattgccgccaggga

SEQ ID NO: 550 - DNA, 101 bp, Mycobacterium tuberculosis
  modified_base (22): a, t, c or g
cgtcagcacggcgacgtcgcgntacgccgagcagttacacaatcgctctgcagcaaaccaatattctgcgcgacgttcgagaggacttcttgattggactg

SEQ ID NO: 551 - DNA, 458 bp, Mycobacterium tuberculosis
  modified_base (181): a, t, c or g
ctgcatccggctcgtatgttgtgtggaattgtgagcggataacaatttcacacaggaaacagctatgaccatgattacgccaagctatttaggtgacactatagaatactcaagcttcgcgcagcggcgggttgacccggttcacgccgtcatagctggccaatctggcatcgtcgatcancatgtggtggggggtgacctcggcggtgatcgaaataccctggtccttatcccatttcaggatttcgacggtgcccgcggccgacgcgtgacagatgtgcacccgggcgccggcgtcacgggccagcaaggcgtcgcgggcgacgatcgattcctcggcggcccgcggccatcccgccaggcccagccgcgccgccatgggtccctcgtgcgcgacggcgccgaccgtcagccggggctcctcggcgtgctgggcgatcagcacgcccaaaccggtg

SEQ ID NO: 552 - DNA, 463 bp, Mycobacterium tuberculosis
ccgacgcgcactacgtgctggtgtccacccgcgacccgcaccggcacgagctacgcagctaccgcatcgtcgatggcgctgtcaccgaggaacctgtcaatgtcgtcgagcagtactgaaccgttccgagaaaggccagcatgaacgtcaccgtatccattccgaccatcctgcggccccacaccggcggccagaagagtgtctcggccagcggcgataccttgggtgccgtcatcagcgacctggaggccagctattcgggcatttccgagcgcctgatggacccgtcttccccaggtaagttgcaccgcttcgtgaacatctacgtcaacgacgaagacgtgcggttctccggcggcttggccaccgcgatcgctgacggtgactcggtcaccatcctccccgccgtggccggtgggtgagcggacacatgacacgatacgactcactgttgcatgccttg

SEQ ID NO: 553 - DNA, 453 bp, Mycobacterium tuberculosis
  modified_base (306): a, t, c or g
tgcttccggctcgtatgttgtgtggaattgtgagcggataacaatttcacacaggaaacagctatgaccatgattacgccaagctatttaggtgacactatagaatactcaagcttgccgggagggtgcatggccgactcggatttacccaccaaggggcgccaacgcggtgtccgcgccgtcgagctgaacgttgctgcccgcctggagaacctggcgctgctgcgcaccctggtcggcgccatcggcaccttcgaggacctggatttcgacgccgtggccgacctgaggttggcggtggacgangtgtgcacccggttgattcgctcggccttgccggatgccaccctgcgcctggtggtcgatccgcgaaaagacgaagttgtggtggaggcttctgctgcctgcgacacccacgacgtggtggcacgggcagctttagctggcattcct

SEQ ID NO: 554 - DNA, 466 bp, Mycobacterium tuberculosis
  modified_base (11): a, t, c or g
ggaaacaccgncgccgtcgtggccaccaacaccgcgaccagcaccgtgacccggaccggggtgccgcgcgaaccggtcttggccaattgccgcggcaccaagccgtcgcgcgccatggcgaacagcacgcggcattgcccgagcatcaacaccatcaccaccgtggtaagcccggccagcgcgccgacggagatgatgccgctggcccagtacaccccgttggcctggaacgcggtggccagatttgccggcccgcggcccggtacggtccgcagttgggtgtatggaaccatgcccgacagcaccaccgataccgcgacgtagagaagggtcacgacccccagcgacgcgagaatccctcgagggacgtctcgttgaggacgcttggtctcctcggccatggtggccacgatgtcaaacccgataaacgcgaagaacacgatcgatgcccggccagcacgccgta

SEQ ID NO: 555 - DNA, 466 bp, Mycobacterium tuberculosis
cctgcttccggctcgtatgttgtgtggaattgtgagcggataacaatttcacacaggaaacagctatgaccatgattacgccaagctatttaggtgacactatagaatactcaagcttgtcctcgggcgtggcctcggccaagaaatcgtcgacgccggcctcctgtgcaatcgccttggcggtcgccgggttgtcaccggtgatcatcacggtgcggatgctcattcggcgcatttcgtcgaagcgttcccgtatgcccaccttgacgatgtccttcagatggacgacgccgatggcccgcgcgctgctgttatcggtccattccgcaacgactaggggtgtccccccgccggagctgatgccgtcgacaatggcacccacctcctcagtggggtggccaccgtgatcgcaaaaccacttcatcaccgcagccgcggcaccttgcggatccgaacggatgcgctc

SEQ ID NO: 556 - DNA, 467 bp, Mycobacterium tuberculosis
  modified_base (383): a, t, c or g
  modified_base (427): a, t, c or g
ttcgttcgatggcgccgccccggctacggtttgacctgtgggtgtcgaattggggtcaaattccgaggtcggcgcgctaagagtggtcatcctgcaccgcccgggggccgaactgcgccggctcacaccgcgcaacaccgaccagctgctgttcgacggcctgccctgggtatcccgcgcgcatgacgagcacgacgaattcgccgagctgctggcttcccgcggtgcggaagtgctgttgctgtcggacctgttgactgaggcactacatcacagcggggccgcccgcatgcaggggatcgccgctgccgtcgacgcaccgcggctgggactgccgctggcgcaagaactttcggcctacctgcgtatctcgacccaagcangttggcgcatgtgctgacgccggcatgacttcaacgaactcccntccgacacgccgaacgaagtgtcgttggtgttgcgtatgc

SEQ ID NO: 557 - DNA, 142 bp, Mycobacterium tuberculosis
gcggcgagtgtggtgggtgccgaacacgaatccaacgacgcactggcggagagataccacttgctgtactggaagcacgtgctgatgatctcccgtggaatgtgcctcgccgccgtctatcgaaaacagtgagcatgctgcg

SEQ ID NO: 558 - DNA, 217 bp, Mycobacterium tuberculosis
caaccgcgctcggcgcgtctgggccttccgccggctccgccgacaattctatctctggatcagcggggctctccgggccggcctccgcgaactcaacaggccgcgccttccggccgaaacattccctagccatatatgatcgcacctcgatacacgatctggcggcaacaccgcaaagcgtccgacgggcccaacctccgcaattcaggtatccggg

SEQ ID NO: 559 - DNA, 147 bp, Mycobacterium tuberculosis
  modified_base (25): a, t, c or g
gaaggtcggcgaaggtgtggctggntgccgatcacgaatccaatgatgcagtggtcggaagatattagccacttgctgttctggagacaggtgctgatgatctcccgtggaatgtccctcgactccgtctatcgaaatctgtgaaca

SEQ ID NO: 560 - DNA, 177 bp, Mycobacterium tuberculosis
  modified_base (76): a, t, c or g
  modified_base (89): a, t, c or g
tcctgcgctctgggccattctcgggtctgccgacaattctatctctggatctgtggggctctcttggccggcctcngcgatctcttcanggcgcgccttccggccgaaacattccctatccatatatgatcgcacctctatacaccgtttggcggcaacaccgcaaagtgtctgtcg

SEQ ID NO: 561 - DNA, 128 bp, Mycobacterium tuberculosis
agctttacgctggcgtatcagcgttggggccgctgccatttcggtcgcccaacgcgttgccagctccctgcgctgtcagggcttgcgcgccaaactggccaccgcaacaaacttggctgagcttgatc

SEQ ID NO: 562 - DNA, 142 bp, Mycobacterium tuberculosis
ctctatctggcgtcacattcgcaatctttagattgcagatatcgataaaatcacccgcgcgacaagaccgccatgtcatcctttcgatgttatttcgccggcctggggaaagcgcaacgacgttgcctacacgttccgccgt

SEQ ID NO: 563 - DNA, 406 bp, Mycobacterium tuberculosis
  modified_base (7): a, t, c or g
  modified_base (343): a, t, c or g
agctttnccttgcatctgcaccccgatccacgtcagccacgtcggcgttctccaccaagaagttgcgggcattctccttgccctggccgagctgctcgccctcgtaggtgaaccaggcacccgacttgcggatgaggccctgatccacacccatgtcgatcagcgagccctccctgctgattcccttgccgtagaggatgtcgaactcggcctgcttgaaggggggcgaacagttgtgcacgacaaccccttcggcgacgagggtgtgcagttcctcgacctcgaggtcgaacgttcgtgcccgccgcgttggcagcacttctcggatcacggaatagcgganttcttccgccagcatgtcgtgcaggaatttgtcatccagggcatccgcgagcgcctgcacgcg

SEQ ID NO: 564 - DNA, 311 bp, Mycobacterium tuberculosis
  modified_base (7): a, t, c or g
  modified_base (62): a, t, c or g
actgtcnagggaatgcttcgcagcatctacctgcagtcgcttgtgcataagcggacggcccnacctgttcgtgttccgggacaccagacgcgggagcaccggcagtacggcgaaaggtttgagcggaaggagttgcgcaaatcggggcgccccaacacccgtccgcaagacgcggtcaacgacctgtttcaggcgatcagggtcaccgactcacctgcactgagaacaagcgatctgctgatctgccagaagatggacatgaatgtccacggcaagcctgatggcctgccgctcttccgggaatgtttggc

SEQ ID NO: 565 - DNA, 310 bp, Mycobacterium tuberculosis
  modified_base (30): a, t, c or g
  modified_base (44): a, t, c or g
  modified_base (69): a, t, c or g
  modified_base (71): a, t, c or g
  modified_base (212): a, t, c or g
  modified_base (257): a, t, c or g
  modified_base (298): a, t, c or g
tgaattatgatcccgacacaactgcatcantttagccgcgtcgngatgctatccgccgacggtttggancnggtccgtgtcgttcgtgttgatctcacccgaagttgtgtccgccgccgccggggatctagcgaacgtgggatcgacaatcagcgccgccaacaaggcggcagcggctgcgaccacgcaggtgctggccgcgggcgccgatnaggtgtcagcgcgcatcgcggcgctgtttggtatgtacggcctgnaatatccggcgatcagtgcgcaagttgccgcgtatcaccancagtccgtgcag

SEQ ID NO: 566 - DNA, 326 bp, Mycobacterium tuberculosis
  modified_base (11): a, t, c or g
  modified_base (27): a, t, c or g
aacggggaccncaagaaaccattcaanaacgaggggtcgtcaccaacgtcgaaaccgacggttgccagccggcccacgatattgcgtgctcgagggtccgctgtaccctcaccgaacgtgagtcccacaccgcggaggcgggcgactctggcgtcgttagcagccgagctcaaggtgtcccgcaccactgtctcgaatgcttttaaccgaccggatcagctctccgccgatctacgtgaacgagtgcttgccacggccaagcgactgggctatgccggaccggatccggtggcgcgatcgttgcggacccgcaaagccggtgcggt

SEQ ID NO: 567 - DNA, 374 bp, Mycobacterium tuberculosis
  modified_base (13): a, t, c or g
  modified_base (15): a, t, c or g
  modified_base (20): a, t, c or g
  modified_base (23): a, t, c or g
  modified_base (93): a, t, c or g
  modified_base (205): a, t, c or g
  modified_base (262): a, t, c or g
  modified_base (268): a, t, c or g
  modified_base (275): a, t, c or g
  modified_base (327): a, t, c or g
agctttggagccncnccganccnccggtacgccccgccaccgccgtacccggcacccgacccctttgagccgttcgccgtggccgcggtgganctggccgacgagggactgatcgtgctgggcaaagtggtcgatggcacgctggccgccgatctgaaggtcggcatggagatggagctgacgaccatgccgctgttcgccgacnacgacggtgtgcagcgcatcgtctacgcgtggcggatcccatcgcgcgccggcgacnatgcanagcgcancgatgctgaggagcggcgccgatgaggatgagcgcgccggaacccgtttacntcctgggtgccggtatgcacccgtgggggaaatggggtaatgacttc

SEQ ID NO: 568 - DNA, 422 bp, Mycobacterium tuberculosis
  modified_base (6): a, t, c or g
  modified_base (20)..(21): a, t, c or g
ttctcncatcgttcgtactnngatgggacgctgctgcccgaggcgatcctggccaaccggctctcgccggcgctgaccttcggcggggcgaacctgaacttctttccgatgggcgcttgggccaaacgtaccggggctatcttcattcggcgtcagacgaaagatattcccgtctaccgcttcgtattacgtgcttacgccgcgcagctggtgcaaaaccatgtcaacctcacctggtcgatcgaagggggtcggaccagaacgggcaagctacggccaccggtgttcgggatcctgcgttacatcaccgatgcggtcgacgaaatcgacggtcccgaagtgtatttggtgccgacctcgatcgtgtacgaacagctgcacgaagtggaagccatgaccaccgaagcctatggcgccgtgaa

SEQ ID NO: 569 - DNA, 300 bp, Mycobacterium tuberculosis
ttcttccgggtaccgctgatcggcggcaccatcacgcacccggtgcagggcgaggcggccgccggtgtggtgttgctacggccggccagcccgggtaccggtgtgatcgccggtggtgcggcccgcgcggtgctggaatgtgcgggggtgcacgacatcttggccaagtcgctgggcagtgacaacgcgatcaatgtggtgcacgccaccgtggccgcgctcaagctgctgcaccgtccggaggaggtggcggcgcgccgcggtttgccaatagaagacgtccccccggccgggatgctg

SEQ ID NO: 570 - DNA, 343 bp, Mycobacterium tuberculosis
gtcgaaagtgaccatctctaccttgagtgccataccgcccgaccctatgcctcggatagctcggcggaaagaaacgcttgcagtgccgccgaataggcggctacgtcgtgagcgcccatcaactctcgcgcggagtgcatcgccagctgggcggcgccgacgtcgaccgtggggattccggtgcgcgccgcggccaacggcccgatcgtcgacccgcacggcagatcggcgcgatgttcgtaacgctgcataggcactcccgcgcgctggcaggccagttgcgaaacgcccccgccgggtgccttccgtcggttggctttaccgcaaatttggggttgcccct

SEQ ID NO: 571 - DNA, 220 bp, Mycobacterium tuberculosis
aaagccacggaaacgattgcctactgccgaatcggggaacggtcctcgcacacctggttcgtgttgcgggaattactcggacaccaaaacgtcaagaactacgacggcagttggacagaatacggctccctggtgggcgccccgatcgagttgggaaactgatatgtgctctggacccaagcaaggactgacattgccggccagcgtctacctggaaaaa

SEQ ID NO: 572 - DNA, 254 bp, Mycobacterium tuberculosis
  modified_base (13): a, t, c or g
  modified_base (234): a, t, c or g
tttcgccaccgcnaggtcgtgcgcgttccagaaaagcgtggtttcgccgggcgcgaggattcgacggtccaactgaccagccggtcccgccacccgttaggcaggatcgcggtgtctatatgttcgccctcggcataaacgccattgctgcggtgaaaatcggacatctcgccgattgccacgtctacatgatccgctttgtcccgcgccgggtcgttgacaaacgcgatgtcngcctcctgggaagcggtggc

SEQ ID NO: 573 - DNA, 329 bp, Mycobacterium tuberculosis
  modified_base (25): a, t, c or g
  modified_base (49): a, t, c or g
  modified_base (169): a, t, c or g
  modified_base (174): a, t, c or g
  modified_base (192): a, t, c or g
  modified_base (235): a, t, c or g
  modified_base (262): a, t, c or g
  modified_base (283): a, t, c or g
tcgccaagtggattcgtgctcaccnacgagatccgtggtcggatccgcngctgcggcgggctgcgaccctgcatctcggcggcacccgtgaccaaatggcgcgcgccgaagcagacgtctcggcgggacgccacgccgactggccgatggtgctggccgcgtgtccgcncgtcnccgaccccggccgcatcnaccaaaccggccgccgtccgttctggacctatcccacgtgccntcggggtccacgctcgacgcgaccganaacgtaaccagcgtcctcgancggttcgcccccggcttccgtgacatcgtggtggcggccgcgccgt

SEQ ID NO: 574 - DNA, 297 bp, Mycobacterium tuberculosis
  modified_base (92): a, t, c or g
  modified_base (95): a, t, c or g
  modified_base (99): a, t, c or g
  modified_base (104): a, t, c or g
  modified_base (107): a, t, c or g
  modified_base (140): a, t, c or g
  modified_base (165): a, t, c or g
  modified_base (177): a, t, c or g
  modified_base (185): a, t, c or g
  modified_base (241): a, t, c or g
  modified_base (257): a, t, c or g
gtaccgtcaccatgatcgcccccatcggcatcggtgagctgatagatcccagccggtttcgccaaccccggagcgatcttggcgcgctgctngtngtcnctganacntagccaccaacagagcccggtgtgcgacaagangactgatcggatctctccggacacntcgagggggtcntcaggagnccgggcgccaccccgaggtaagcctccgcccagcctcacaccgcgaccgggtatcncaagtcgcgcaataancccaccacctcctcggaccccacgttgtatgcggctgggt

SEQ ID NO: 575 - DNA, 401 bp, Mycobacterium tuberculosis
  modified_base (280): a, t, c or g
  modified_base (356): a, t, c or g
atactcaagcttagacctcactgatgtggcgggacgcgggagataaccgcggttcgagccgttcaacagtggtggttcccacaccagttgtttgcctttgcgaagtaaagcgattcgatttgctcgaaaagagggctggctgctcgtgagggacatccatggccgatacctcagcgatctcaacggtcaagcgactgcatgtttggcgcaaggtatcgctaagcataggttcgtgacggatttgacagcaagagctttccaaagattgctgtccacatantgattcgcatctctacacctcttcgccggtgctgtcaagagccattcgaatcagttatctcgctcgtgcttggaanaaattttcccagcctgcgttggacaaaccgcgtcgccaaagcggt

SEQ ID NO: 576 - DNA, 453 bp, Mycobacterium tuberculosis
agcttcccgagaaacagtgcattccctaagcagcccgttgtcacgccgatgagtgaagagtgcacgcaatcgccggaatccggcaaagccctgcacaagcgaaatcaacccggaggctgacaaggcaacgtcggtgatccgtaccgcctggttggacaaacggcagaaggcggcctcgtccggtccatctacgccgagcacactggtgatagcgcgcatcggcatcggtgcggccacggtggagacgacgtccgcgggcgtctgggtcagtaacccgccgaccagttctcgggcaagctggtcgaccatcgggcgccacgtctccaacgcgccacgcgccatacctggtgccagttgcttgcgcatccgggtgtgcgccggcggatcggacgtcgcagaaacgcagccaccccgtgagaagtgacccacggcgctggacacgtgtctggttac

SEQ ID NO: 577 - DNA, 474 bp, Mycobacterium tuberculosis
  modified_base (106): a, t, c or g
  modified_base (261): a, t, c or g
  modified_base (323): a, t, c or g
cggccgggatgtgcgcaatggcaggttgtcgcccggcttgatgtcggcgttagcgccggattccaccacatccccttgcgaaagtccgttgggtgcaatgatgtancgcttctccccatcgagatagtggagcaacgcaatccgtgcggtacggttcgggtcgtactcgatgtgcgcgaccttggcgttgacaccatctttgtcatggcggcgaaagtcgatcatccggtaagcgcgcttatgaccgccgcctttgtgccnggtggtaatccggccatgcgcgttgcgtccaccgcgaccgtgcagcgggcgcaccagcgacntctccggggttgaccgggtgatctcggcgaaatcagatacgctggcgccgcgacgaccaggcgtcgtgggcttgtacttgcgaattgccatggtctaatcaggtctttctctcacctctcgtcgccgggctagggcgcattgcctgctcct

SEQ ID NO: 578 - DNA, 357 bp, Mycobacterium tuberculosis
  modified_base (289): a, t, c or g
tagcggtgtaaccaactcccgggtcaccacccgcaaacctcttgcggcaacagcaccgtcgacgcgtcaaccgggctgcccggaatcctgtggatgggcatcgagtgcatggtcacgacgtccccgacgcggccggtggcaacgacaagtggcccggatgcaccacaaatgacggccgcacaccggtggggacggccagcacgagagccgtgtcgccgaagtcgacgctaatgccgtaggcattggccgtcacaacaggcgacgccccgcgtaccaccgagtccacggnggttgggcggtctcctcggccaaccaggcgtgaacccggcggatccgaatgcagcaagacccgtgggc

SEQ ID NO: 579 - DNA, 269 bp, Mycobacterium tuberculosis
  modified_base (25): a, t, c or g
  modified_base (29): a, t, c or g
  modified_base (224): a, t, c or g
  modified_base (246): a, t, c or g
ccattggtcggtgtgcgcataccantacnacgcgccgggcacctgacgcggcggccgcaaccattcggtggccatcgccatcgtctgccacccggtcaacggacgcaccttctcctggccgacctagtgcgcccacccgccgccgttgcgtcccatcgatccggtcaacatgagcagcgccaacaccgagcggtacatgacatctgctgtggaaccagtgacanattccgccgcccatgatgatcntcgaccgtcctccggattcggtc

SEQ ID NO: 580 - DNA, 272 bp, Mycobacterium tuberculosis
  modified_base (31): a, t, c or g
  modified_base (112): a, t, c or g
  modified_base (228): a, t, c or g
  modified_base (234): a, t, c or g
gccggcctggtcaaaggggcgtccgaagganccgggctgggtaacaagttcctggctcatatccgcgaatgcgacgccatttgtcaggtggtgcgggtgttcgtcgacgacnacgtgactcatgtcaccggacgggtcgatccccagtccgacattgaggtcgtcgagaccgagctgatcctggcagatctgcaaaccctggagcgggccacgggccggctggagaangaagcncgcaccaacaaggcgcgcaagccggtctacgacccggc

SEQ ID NO: 581 - DNA, 373 bp, Mycobacterium tuberculosis
  modified_base (181): a, t, c or g
  modified_base (261): a, t, c or g
gatccactgaccacgatgacatatcgaaatgctcgacgattccgatggcgatcaaggccacgatgccctggccgttgggcggtatctggtggatggtgtacccgcggtaggttcccgtgatcgtgtcgacccagtccacgcgatgggcggcgaggtcgtcggcacgcatcaccccgccgtntgccgccgagtgcgcctcgagtttggcggccagctctccccggtagaactctcaccgttggtcgccgcgatcttctctancgtcgccgcgtggtcaggaaaggtaaacagctcaccgggtttcggcgctcgtccgccgggcatgaacgcatctgcgaatccgggctgggatgcgaacaacggacctgtgccg

SEQ ID NO: 582 - DNA, 314 bp, Mycobacterium tuberculosis
  modified_base (36): a, t, c or g
  modified_base (100): a, t, c or g
  modified_base (113): a, t, c or g
  modified_base (132): a, t, c or g
  modified_base (142): a, t, c or g
  modified_base (208): a, t, c or g
tctactgccgaatcggggaacggtcctcgcccaccnggttcgtgttgccggaattactcaggacaccgaaacgtcgagaactacgagcggagttggacanaataccgctcccnggtgggcgcccccatcganttgggaagcngaaatgtgctctggaccccacccaagaatgacattgccggccgccctccaactggaaatagaaacngtgatcacccgccgcgttcttggaaggaatggcatgccctgggccgggcgttccttccgctgccggactcctcccaccaattcaccgccgaaggcgtcccgtctgc

SEQ ID NO: 583 - DNA, 135 bp, Mycobacterium tuberculosis
atactcaagcttctgtcaccgaaatcccgcatgggataacgggtttagatttcgacaacgggaccgtgtttctcaacaagccggtcatcagctgggccggcgacaacggtatctacttcacccgctttcgcccgt

SEQ ID NO: 584 - DNA, 221 bp, Mycobacterium tuberculosis
ctggctcaagcgctcggcgcgcaggtgaactcggaccggctcgacgtcgccgaacgcgaggcggtgctggcccacgccgacgccgtcgtcgcacatatcggcaccgtgcacaagtctacaacaacgccggcatcgcgtacaacggcaacgtcgacaagtcggagttcaaggacatcgagcgcatcatcgacgtcgacttctggggcgtcctccacgggccc

SEQ ID NO: 585 - DNA, 70 bp, Mycobacterium tuberculosis
  modified_base (70): a, t, c or g
ccgccctccgcattatgggtcaagaaccatcgggtcggacttctgggcttccaacgctcgcgccgtcccn

SEQ ID NO: 586 - DNA, 241 bp, Mycobacterium tuberculosis
ccgtggcactgtcagacatatgcgccgctcctcctcatcgctgcgctcggcatcgtcgccggcggtcatggcgtcaccctacccaagccgaacgcgaaacgagaacgtgttccattattagggtgtgagcaccaataccagattgctcaccaggaactcacgcagcaccgggacggatgtcggccaccacgcccatctggggtggtagcggggaaataccgctaacgcggctccggtgccg

SEQ ID NO: 587 - DNA, 492 bp, Mycobacterium tuberculosis
tactcaagcttgtccaaatatcgaagcgtcgggtcgcgaggctcggtcggcagctccagcaaaacccgctccacccctagatgccggtatccctcaaggtctttatccgccgcttcaccccactggcacacggtcaccggcacgtcgcccccggccatggcgcgcaaccgctgaagcggacccgacagccgctgcggtgatggactgatcgcgatccacccggcattgagccgggctatccgcgggaagttcgccggtcccccgcccacatacagcggaggatagggctttgtcaccggcttcggccagcagtagatcggatcgaagtccacatatgtcccatggaattccgcctgctcctgcgttcagatctcgattatcgcgcgcaaccgctcatcgatcacacgtccgcgcaccgcagggtccacaccatggttggcgacttcttcgcgcaaccagccacacccacgccgaaacgaaaccgtccctgcg

SEQ ID NO: 588 - DNA, 313 bp, Mycobacterium tuberculosis
  modified_base (250): a, t, c or g
caggcatgcaagcttggccaactcctcatcggacttgaaggtgccgtcctcgttggcggccctgctccacggcacgttgatggcaccaggaatgtgtccgggccgctggctttgttcctgcggcaggtgcgcgggggccaggatcttgccggagaactcgtcgggagagcgcacgtcgatgaggttcttgacgttgatggccgccaggacctcgtcgcggaatgcccgaatcgtgttatccggcggggangcggtgtaggaagtcaccggccggctgaccgggtcgctggacagcgggcgtccgtcgagctcc

SEQ ID NO: 589 - DNA, 305 bp, Mycobacterium tuberculosis
  modified_base (265): a, t, c or g
atactcaagcttcaaaacaggcctgttgtgggcgcacccggctcgccgagttctgcacgcaccgcctcaagtgcggcccgcaccgccggcatctcccggtcacgcagggccgcggcccgcgccgcagcgacggcgtgttcgcgcagttcgccgtcaatgatgctgacctgatcggccacccgggcggtctcggcgtcgtcccgttcactaatcgcggtgctcagcagcgtctcgacagccaccacccgagtggagaccagatgcnccaccacggaccgcagcgatgccagtcacctcacccgtcc

SEQ ID NO: 590 - DNA, 394 bp, Mycobacterium tuberculosis
caggcatgcaagctttgcagttgctgagtaatgtcggccaacgtcaccacaatcgcgatgaattcaatcatgccgcccagggcggccaacccaatggtggccgcgagcggcagctcgatcgcagcgcggaggttgccggccgccagttgattcacgaacagggtgaggtcataggcgggcaggatagtgacgaaggcaagacctagatctgccgtcggaagaagaatcgagtatccggtcgacacaacggaagcgaaagtgtccgcgatgttgatgagcgtcgccggttgtggcggcggtggcggcggtagcaccgtccgcacataccgcgggaacgcgggcatccgaatttggggcagggtgttcaaggcggctggcaactcaccatgaatct

SEQ ID NO: 591 - DNA, 457 bp, Mycobacterium tuberculosis
  modified_base (445): a, t, c or g
ccggctcgtatgttgtgtggaattgtgaccggataacaatttcacacaggaaacagctatgaccatgattacgccaagctatttaggtgacactatagaatactcaagcttggccgcagggccgagtcgattggtcgcggtcgcctcgacagttagcttatgcaatgctaacttcggggcaaagttcaggcggatcggccgatggcgggcgtaggtgaaggagacagcggaggcgtggagcgtgatgacattggcatggtggccgcttcccccgtcgcgtctcgggtaaatggcaaggtagacgctgacgtcgtcggtcgatttgccacctgctgccgtgccctgggcatcgcggtttaccagcgtaaacgtccgccggacctggctgccgcccggtctggtttcgccgcgctgacccgcgtcgcccatgacagtgcgaccctgnaccgggctggcc

SEQ ID NO: 592 - DNA, 438 bp, Mycobacterium tuberculosis
gtgtgctgtcaattcagagctgagcctgatgcactcaacttactgagcatgctaacgctggtcgtgcgggtcttgttcccgcgtgtcggcagggcacacgctcggggcgtagctgggagaggccccggtcaagcccggagagcagtgctcagtccgccagcttgaccgactttcgatgagaacgcgcttctcgccgtattgaactggcgtgctgacggtcgctgagcagcgctcgccgagtgcggccgctgattctttcatcgagccaggaggcgcattcgtgttcggccgcctgcgggtcggccccatcgtcgacgcgatccgtcacccactcctcgatcaggtctgcctcatcgaacgggccaacggtgctgtcggagtaagtgtgcgtgggcacgcgagccgggtgctgtggtacacccaccgttgcatgaacaa

SEQ ID NO: 593 - DNA, 220 bp, Mycobacterium tuberculosis
atactcaagcttcaccaggcgccggcgggccgcggcgccaagccaggcagccgcgctcggcgcgtcggggccttccgccggctcggccgacagttcgatctctggatcggcggggctctccgggccggcctcggcgacctcagcgggccgcgccttccggccgaaccattccctagccatagataaccgcacctcaatgcacggtttggcggcaacccgg

SEQ ID NO: 594 - DNA, 266 bp, Mycobacterium tuberculosis
agcttccgtcacgacccgccctcgccggtgccggcgccatcggtcatcggatctcatgacgacgtcacgtaggcccgctagccgcgagcgggcgcggtcaactggcgaggcggcggcgacgtgactgagctggccgagctggaccggttcaccgcggaactaccgttctcgctcgacgactttcagcagcgggcttgcagcgcgctggaacgcggccacggtgttgctggtgtgcgcgccgaccggcgctggcaagacggtggtcg

SEQ ID NO: 595 - DNA, 105 bp, Mycobacterium tuberculosis
atactcaagcttgccgggaccgcggaacagaaccggcggttcctaccgcggtgtgcggccggcgcgatatcggcctcccgactaaccgaacccgatgtgggctcc

SEQ ID NO: 596 - DNA, 141 bp, Mycobacterium tuberculosis
  modified_base (138): a, t, c or g
acgttggctctgccggaacgtatttccagcggcacgcattcggcgtgggtgccgggcgccgagttgcgtcgctgggatcacgcagcagtcgccggcggctgccgtcgggctatgaattgcaccgagccggaaaatccncac

SEQ ID NO: 597 - DNA, 234 bp, Mycobacterium tuberculosis
atactcaagcttgtcgtattccgtggcactgtcagacatatgcgccgctcctcctcatcgctgcgctcggcatcgtcgccggcggtcatggcgtcaccctacccaagccgaacgcgaaacgagaacgtgttccattattagggtgtgagcaccaataccagattgctcaccaggaactcacgcagcaccgggacggatgtcagccaccacccccatctggggtggtagcgggga

SEQ ID NO: 598 - DNA, 184 bp, Mycobacterium tuberculosis
cgttggtagcccgatatgcatagtgtatcttactgaacatgatttccattatggagcccggggtgccggcagcgcgaacggtgcgccgtcagacgcgggcggcactgaccagggtgttgcgggcgaacatcggcccggcttcggattccggtccgggtaccgggcgacccaccgcttcgaggta

SEQ ID NO: 599 - DNA, 351 bp, Mycobacterium tuberculosis
  modified_base (335): a, t, c or g
atactcaagcttggccaactcctcatcggacttgaaggtgccgtcctcgttggcggccctgctccacggcacgttgatggcaccaggaatgtgtccgggccgctggctttgttcctgcggcaggtgcgcgggggccatgatcttgccggaaaactcgtcgggagagcgcacgtcgatgaggttcttgacgttgatggccgccaggacctcgtcgcggaatgcccgaatcgtgttatccggcggggaggcggtgtatgaggtcaccggccggctgaccgggtcgctggacagcgggcgtccgtccagctcccacttcttgcgggcgccgtccaacnacttgacttctcctgg

SEQ ID NO: 600 - DNA, 438 bp, Mycobacterium tuberculosis
atatcttaagcgtcgggtcccgaggctcggtcggcagctccagcaaaacccgctccacccctagatgccggtatccctcaaggtctttagccgccgcttcaccccactggcacacggtcaccggcacgtcgcccccggccatggcgcgcaaccgctgaagcggacccgacagccgctgcggtgatggactgatcgcgatccacccggcattgagccgggctatccgcgggaagttcgccggtcccccgcccacatacagcggaggatagggctttgtcaccggcttcggccagcagtagatcggatcgaagtccacatatgtcccatggaattccgcctgctcctgcgtccagatctcgattatcgcgcgcaaccgctcatcgatcacacgtccgcgcaccgcagggtccacaccatggttggcgacttcttcgcgca

SEQ ID NO: 601 - DNA, 410 bp, Mycobacterium tuberculosis
atactcaagcttgtcgcggtaaacccgcagcagggcggtgggtgcggtgtcaaaaacaaccacacttctttgcggttcggtgatctcgacaccggccgcgagccgaccaccatgcgcgcgtaaatcggcgatcagcgcgtcggctatcgcctgggtgccgcccaccggaatcggccagccgaccgaatgggccagcgttgccagcatcagtccggcgccggccgacaccagtgacggcaacggtgaaatcgcgtgggcggcaacgccggtgaacaacgcgcgggcatcctcgcccgccagcgaccgccaggcaggggtgccctgggccagcatccgcagcccgagacgcaggaccgagcccagtgcagtaggcaaagaccgcttgtcggagacatgaactccacgaccgt

SEQ ID NO: 602 - DNA, 456 bp, Mycobacterium tuberculosis
agcttattgaaccgcgggtcgcaggcaaagtggacctcataacgactcgggtccagcgaccgcgccaacacgaacggccggacgacgtgggccagggtcgcggcctcccctacaaacaggatccgttgcctgcgagcgacaggctccggtgcggcgttgggcgccgtgctcgtcccagcgtccggtcccgggtcgccggcgacgcttgtttcctccatactcgccccctaatctcgaggcagcccgtacccgcaggcaacctcccaaaaatgcaatcccccaaaatgcaatgcgtcgagctatttctcacaccgaccgctagttgcggatcagaaatccgttgggcgcggaagtccagccgaatttgttctcccgctccgcatcatgcttgtaatcgtttggaaattcatcctcatatgcctcgatcgcttcatagggtccaggccaaaccgggca

SEQ ID NO: 603 - DNA, 217 bp, Mycobacterium tuberculosis
cttccggctcgtatgttgtgtggaattgtgagcggataacaatttcacacaggaaacagctatgaccatgattacgccaagctatttaggtgacactatagaatactcaagcttggccacctcgcggtgtgtggtggaacccatctgagcagtgtgccaaaccggggcagacagctcccaattgacgtgagcccgctcacttgctgggtaagcgtcg

SEQ ID NO: 604 - DNA, 478 bp, Mycobacterium tuberculosis
tagcgccccctcccgggcggagctccacggcgtggatcaaggtaccggccgggatgttgcgcaatggcaggttgttgcccggcttgatgtcggcgttagcgccggattccaccacatccccttgcgaaagtccgttgggtgcaatgatgtagcgcttctccccatcgagatagtggagcaacgcaatccgtgcggtacggttcgggtcgtactcgatgtgcgcgaccttggcgttgacaccatctttgtcattgcggcgaaagtcgatcatccggtaagcgcgcttatgaccgccgcctttgtgccgggtggtaatccggccatgcgcgttgcgtccaccgcgaccgtgcagcgggcgcaccagcgacttctccggggttgaccgggtgatctcggcgaaatcagatacgctggcgccgcgacgaccaagcgtcgtgggcttgttcttgcgaattgcatgtctaatcaggtctttctc

SEQ ID NO: 605 - DNA, 459 bp, Mycobacterium tuberculosis
tgaaactatataatactcaagcttgccaaagaagacctcgtcgaccaagcaggacgcgaccgtcgaggtggcgatccggcttggcgtcgacccgcgtaaggcaaaccagatggttcgcggcacggtcaacctgccacacggcactggtaagactgcccgcgtcgcggtattcgcggttggtgaaaaggccgatgctgccgttgccgcgggggcggatgttgtcgggagtgacgatctgatcgaaaggattcagggcggctggctggaattcgatgccgcgatcgcgacaccggatcagatggccaaagtcggtcgcatcgctcgggtgctgggtccgcgcggcctgatgcccaacccgaaaaccggcaccgtcaccgccgacgtcgccaaggccgtcgcggacatcaagggcggcaagatcaacttccgggttgacaagcaggccaacctgcacttctc

SEQ ID NO: 606 - DNA, 464 bp, Mycobacterium tuberculosis
gctgagctccacggcgtggatcaaggtaccggccgggatgttgcgcaatggcaggttgttgcccggcttgatgtcggcgttagcgccggattccaccacatccccttgcgaaagtccgttgggtgcaatgatgtagcgcttctccccatcgagatagtggagcaacgcaatccgtgcggtacggttcgggtcgtactcgatgtgcgcgaccttggcgttgacaccatctttgtcattgcggcgaaagtcgatcatccggtaagcgcgcttatgaccgccgcctttgtgccgggtggtaatccggccatgcgcgttgcgtccaccgcgaccgtgcagcgggcgcaccagcgacttctccggggttgaccgggtgatctcggcgaaatcagatacgctggcgccgcgacgaccaggcgtcgtgggcttgtacttgcgaattgccatgtctaatcaggtctttctct

SEQ ID NO: 607 - DNA, 205 bp, Mycobacterium tuberculosis
atactcaagcttgttggtgacctcgccggcgaacagttctcgcacgatttccggattagcgggactggtcaccagttgggtatgcgggaaggcgctgacgttcgccgcgattagctgtttgatggacgcggcggtgatgtcctgatcacggaactggctgtaatagcccagggtcgccacgcttccatccgggcccggacccggc

SEQ ID NO: 608 - DNA, 244 bp, Mycobacterium tuberculosis
gatgatcgccggtgccaccccgatccgtgcctcggtcagcgcgaacgtgctttccggtccggcgaccaccatgtcgcacgcaccgaccaggccgaacccgccggcccgcacatgcccgttgatggcgccgaccaccggcagcggcgactcgacgatggcgcgcaacagcgccgtcatttcccgcgcccgcgccaccgccatccggtacggatcaccaccacctccgccggcctcgctgaggtcc

SEQ ID NO: 609 - DNA, 289 bp, Mycobacterium tuberculosis; identical to SEQ ID NO: 2

SEQ ID NO: 610 - DNA, 282 bp, Mycobacterium tuberculosis
  modified_base (18): a, t, c or g
  modified_base (21): a, t, c or g
  modified_base (243): a, t, c or g
  modified_base (281): a, t, c or g
ttggcgggttggccacancancccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtccancgccgttcacctacgtgaccttgatgggatccgggggnt

SEQ ID NO: 611 - DNA, 312 bp, Mycobacterium tuberculosis
  modified_base (1): a, t, c or g
  modified_base (20): a, t, c or g
  modified_base (43): a, t, c or g
  modified_base (47): a, t, c or g
ncgtggacaccggtgtcgancgccaccagccgcatgtctgcangtcnattccgtcctcggcaacatcttgaatgccgagcagcgcctgggcgtgatcggcaaccggggatgaccgctcgccgatccgctcgacaatcccggcggcacgtgacatgccggcggacggctcgacgagctggaacttcagcgacgacgatccggaattgatcaccagcacggtgctactcatggacccctgcgcctgaatcccgtgatggccacggtgttgactattcgtcgacagtgcacccgagatagtcttcacggctgcgt

SEQ ID NO: 612 - DNA, 349 bp, Mycobacterium tuberculosis
  modified_base (129): a, t, c or g
  modified_base (256): a, t, c or g
  modified_base (262): a, t, c or g
  modified_base (265): a, t, c or g
  modified_base (285): a, t, c or g
catgtattgccgtgctcacggcgccacgctcgatggtttctcgaagtctccgggctggtgtacagcttctcgttgatctcgttcgccacgccgtcctcttcccgccgacgacccgatctcgatctccanaatgatcttggcggccgccgccgccttgagcagctcctgggcgatggccaggttctcatcgatgggcactgccgaccgtcccacatgtgcgacggaacaaagatgtcaccttgctcacgcgtgcgcnagatcncanaagggccggacatactgtcnacttgtccttgggcagtggtccgtgtcagcccacgtgacgggtacttggcgcgataacgtggtg

SEQ ID NO: 613 - DNA, 350 bp, Mycobacterium tuberculosis
gccaccacgacccggccgtaactctgctcacggaaatgcggccaggccgcgcgtagcacgtggtatccgccataaaggtgcaccttaagcacggcgtcccaattctcgaacgacatcttgtggaaggtgccgtcgcgcaagatcccggcgttgctcaccacaccgtgcacggcgccgaattcgtcaagcgcggtcttgatgatgttcgctgcgccgtcctcggtggcgacgctgtccttagttggcgaccgcccggccccccttgtcgcgaatctcggcgacgacctcatcggccatcgccgaacggcgcccgtgcccgtcgcgggcgccaccgaggtcgttgaccacga

SEQ ID NO: 614 - DNA, 126 bp, Mycobacterium tuberculosis
caggcatgcaacctttgtccacacggcgtctactccgtgcaaggtccgaccgcttccacgtcccgccgtgacggtgctccatctccctcagcaacgcgtgaagtggtccgatcccgcggcttcagg

SEQ ID NO: 615 - DNA, 395 bp, Mycobacterium tuberculosis
  modified_base (356): a, t, c or g
gttgagacgcaaccagcgcacaacgacgatttggcgtagcggcggacgtctgctcgattcgatcacgtcgcgctcgcatcgagcatggcccgcgacgctacacgatcgccgtcgtcgatgacacgaccgagccgtacgccggccgtaagccgcgccaggattcggcgaaaaacgtctacgtggcgggtgtactgggtgtcgaatgattcgtggggtgcgtatgcgtcctgcaatcgtcgacatagatccgtcgccgcatcgcgtcgacaactccgggtgagtggaatacacttgccgatcacgcgacgtgcgcggatcgatgccgaccgaaatacgaccacatggctcttgttgcncagtgttggcggcatcaaataccctcagtgccgtccgac

SEQ ID NO: 616 - DNA, 371 bp, Mycobacterium tuberculosis
  modified_base (3): a, t, c or g
  modified_base (11): a, t, c or g
  modified_base (23): a, t, c or g
ttnccgccttnacgcctactccnagacgatgctcgacgcgtgtgagcacacggcgctgctgtagacggcacggcgcagctggatcgcgcttggtgcacccaagcctctacgcgcgtcgctgcgtcgtcatcgggtaccgaacatattccggtcgttgcgcagagtgtgcatgtgcggctcttgtgaacgaacatagcaaagcgtatatgtctgtggcggctctgcagatatcgcgataatacgtatatacataaggtggcgcgcgatctatcggtatatccgttatggcggacgtgcgtgagcgtgagtcgcggcgcatcgcgcacttcgcgatcgcgtgactggtcctcgcgactgcgcgcatgcgtagc

SEQ ID NO: 617 - DNA, 423 bp, Mycobacterium tuberculosis
  modified_base (86): a, t, c or g
  modified_base (185): a, t, c or g
  modified_base (191): a, t, c or g
ggtgatgacgcacttgcttcgaatgagtcattgactactcccgtggttgtcctgcgatggtggagtgccgcgcagccttgcccgangtcgcgatcgcgtcgcgggcttcggggagcagactgacctgcagatggaagtcgtgccacatgcccgcgaacggcgagctcgatgcttgttttcgaagngcgcangcggtttcgatcttgtccgcgtcaacgcagatcggatctcgccgcggtctgcatgacgatgggcgcaggcccgctcatgtcccgtagacggggagatacgggcagccgcggatcgagacctacgtagcgcggcgcccatcgtgccatcgacgaagaatgacggatcgcgcagcgccgtcgcgtcgcttcgatgtcacgcgagatcgccacggcagatcagcgatgcgcgggc

SEQ ID NO: 618 - DNA, 354 bp, Mycobacterium tuberculosis
cggtacgccggcaacaaacgccttgtgacgagcgcgtccgagcggtcatcggcctccaccgtcatgcacagctccttctccaggtctacgccgacgtcgcggtccacattggtgagcttggcgaatgcctcggcaacctcgtcgaaatgcgcctccgcgtccgcatcgaaggtcgccatgtcaaagatcaactcgacgtagtagctagttaccgcatcaggtcagtgtttgctggcctcggagtccggccgaacaatggccatttcccgcgactctagaatccagtcatcgtctcggtgacgacgccttgccgatcacatagctcgaccggatcggagagaatctggttctcgt

SEQ ID NO: 619 - DNA, 128 bp, Mycobacterium tuberculosis
atactcaagcttaagcgcagcagtaccggcggtgcctgggcatcccagcaaaacggggagctcaacgaacgattcctgaacgaagggtcgtccaccaacctccaaaccgaacggttgccagccccggc

SEQ ID NO: 620 - DNA, 295 bp, Mycobacterium tuberculosis
  modified_base (31): a, t, c or g
gcaagtccgctcaatgtggttgtgatcacangactacgtcgcctcaatcagctcaaacgtcaccccgtggcgtgctgcgcagcatgaaggtcggcgcccgcacgatgtgggcgaagcaacaggtaataactggtcggcatgggtcaaccctcattgggccgttgcggatcgggtgcacgcccggagtgccggtcgaactcaacaccgccttcaccgatcttttcgtcgaaaatggcggtcgtgtcggggtatacgtccgcgatcccacgaggcggaatccgctgagccgcactga

SEQ ID NO: 621 - DNA, 361 bp, Mycobacterium tuberculosis
  modified_base (47): a, t, c or g
  modified_base (53): a, t, c or g
  modified_base (88): a, t, c or g
  modified_base (151): a, t, c or g
  modified_base (193): a, t, c or g
  modified_base (196)..(197): a, t, c or g
  modified_base (199)..(200): a, t, c or g
  modified_base (202): a, t, c or g
  modified_base (250): a, t, c or g
  modified_base (255): a, t, c or g
  modified_base (266): a, t, c or g
atactcaagcttcgcgccctcaagcggctgaaggtggttccggcgtnccaacngtcgggcaactcgccgatgggcatggtgctcgacnccgtcccggtgatcccgccggagctgcgcccgatggtgcagctcgacggcggccggttcgccncgtccgacttgaacgacctgtaccgcagggtgatcaaccgcnacnncnngntgaaaaggctgatcgatctgggtgcgccggaaatcatcgtcaacaacnagaancggatgctgcnggaatccgtggacgcgctgttcgacaatggccgccgcggccggcccgtcaccgggccgggcaaccgtccgctcaagtcgctttccgatctgctca

SEQ ID NO: 622 - DNA, 361 bp, Mycobacterium tuberculosis
  modified_base (153): a, t, c or g
tgcgcatggcagttgttgccggcttgagtcgcgttagcgcggattccaccacatcccttgcgaagtcgtgggtgcaatgatgtagcgcttctcccatcgagatagtggagcaacgcaatccgtgcgtacgttgggtcgtactcgagtgcgcancttggcgttgacaccatctttgtcattgcggcgaagtcgatcatccggtaagcgcgcttatcgacgccgcctctgtgccgggtggtaatccggccatgcgcttgcgtccaccgcgacgtgcagcgggcgcacaccgacttctccgggtgacgggtgatctcggcgaatcagaacctggcgcgcgacacagcgtcgtggctgtacttgc

SEQ ID NO: 623 - DNA, 312 bp, Mycobacterium tuberculosis
  modified_base (112): a, t, c or g
  modified_base (119): a, t, c or g
tgggtgatcagatactggctagttggtcgggtggggtgatcgaagatcgcggtggccggcagcgttactgcggtgacgctgttaagcggttacgtactccacggcactcaangaattanatcccgaatcggcaaaccctggccagcgtcgagtccgcagcgccgtcgcgccccccaccgctgcggcatgctcacataccacctcgatcgctgcgggagttgctcgtcggccgaccgaccggccagccgggcggcaaaccggaggacccaagattcagcaccaccatcgctagcccgatctggccgcgcgtgg

SEQ ID NO: 624 - DNA, 454 bp, Mycobacterium tuberculosis
  modified_base (19): a, t, c or g
  modified_base (308): a, t, c or g
  modified_base (350): a, t, c or g
tcgtagcggttgcgaccantccgcggacagctccgccacgcgacgggtcgggatcaccgcggtcaaaccaccgagcggcgaggatctctggccgtcgacgtgaccgcgcacggccgcggtgatggccagtcccgaccgccgttccacttggcgtacgcgctggatgtgttgtgccgcaacggaatcccacctcaattatgacctcgttgtgggcgagcgcggtatcgtacgcccgaccaggaatcgtcgatgctatctcacgtcaccgaaggcctctcccagcacaccgcatccagaacgtgcacacngtcgacatgtctcggcggatccgcctgcagaacgaacgccangtgcgctgtgcgacacgggtcgcgatcaccgctcgcacgcggagatcggcacacgcgcagcgcatcgatcataatctctcgatgcggtctccaccaccgaacag

SEQ ID NO: 625 - DNA, 366 bp, Mycobacterium tuberculosis
  modified_base (145): a, t, c or g
atactcaagcttcgctgaggtggtggggcacgatcacgtcaccgcaccgctgtcggtggcgctggatgccggccggatcaaccacgcgtacctgttctctgggccgcgtggctgcggaaagacgtcgtcagcgcgtatcctggcncggtcgttgaactgtgcgcagggccctaccgccaacccgtgcggggtctgcgaatcctgcgtttcgttggcgcccaacgcccccggcagcatcgacgtggtagagctggatgccgccagccacggcggcgtggacgacacccgcgagctgcgggaccgcgcgttctatgcgccggtccactcacggtaccgggtatttatcgtcgacgaggcgcacatggt

SEQ ID NO: 626 - DNA, 363 bp, Mycobacterium tuberculosis
gcactcacgctggtacaagaccttcacaaaatctgaaatcctgacccgatacttgaacctggtctcgttcggcaataactcgttcggcgtgcaggacgcggcgcaaacgtacttcggcatcaacgcgtccgacctgaattggcagcaagcggcgctgctggccggcatggtgcaatcgaccagcacgctcaacccgtacaccaaccccgacggcgcgctggcccggcggaacgtggtcctcgacaccatgatcgagaaccttcccggggaggcggaggcgttgcgtgccgccaaggccgatccgctgggggtactgccgcagcccaatgagttgccgcgcggctgcatcgcggccggcgaccg

SEQ ID NO: 627 - DNA, 367 bp, Mycobacterium tuberculosis
atactcaagcttgtataaaaagatcggtgagcgcatcgattcgctccgccgggtttgccgctgcggcggcggagctgccgtgaccgtctatttgggtgatcagatactgggctagttcggtcggggtggggtgatcgaagatcgcggtggccggcagcgttactgcggtgacggctgttaagcggttacgtacctccacggcactcaaggaattaaatcccgaatcggcaaacgcctggccagcgtcgaatccggcagcgccgtcgcgccccagcaccgctgcggcatgctcacataccacctccatcgctgcggcgaattgctcgtcggccgaccgaccggccagccgggcggcaaacccggaaga

SEQ ID NO: 628 - DNA, 518 bp, Mycobacterium tuberculosis
  modified_base (104): a, t, c or g
  modified_base (114): a, t, c or g
  modified_base (194): a, t, c or g
  modified_base (358): a, t, c or g
  modified_base (364): a, t, c or g
  modified_base (389): a, t, c or g
  modified_base (408): a, t, c or g
  modified_base (442): a, t, c or g
  modified_base (448): a, t, c or g
  modified_base (452): a, t, c or g
  modified_base (465): a, t, c or g
  modified_base (492): a, t, c or g
cctcatcatatgccgatagagctctacatattcaggagatcaccatggctcgtgcggtcgggatcgactcgggaccaccaactccgtcgtctcggttctggaangtggcgaccnggtcgtcgtcgccaactccggagggctccaggaccacccgtcaattgtcgcgttcgcccgcaacggtgaggtgctggtcngccagcccgccaagaacaggcagtgaccaacgtcgatcgcaccgtgcgctcggtcaagcgaccatgggcagcgactggtccatagagattgacgcaagaaatacacgcccggagatctcgccgcattctgatgaactgaacgcgacccgaggctactcggtgangacatnacgacgcgttatcacaccccgcctncttcaatgaccccacgtcnggcaccaaggacccggcaatcgcggctcacttgngcgatngtcnacaaccaacgcgncgcctggctacgggctcaacaaggcanaagacacaatccgctctcgattggtg

SEQ ID NO: 629 - DNA, 435 bp, Mycobacterium tuberculosis
atactcaagcttatcgaggcggcgcataccgaagcgtgggaaatccagaccgaataccgcgacgtgctggacactttggccggcgagctgctggaaaaggagaccctgcaccgacccgagctggaaagcatcttcgctgacgtcgaaaagcggccgcggctcaccatgttcgacaacttcggtggccggatcccgtcggacaaaccgcccatcaagacacccggcgagctcgcgatcgaacgcggcgaaccttggccccagccggtccccgagccggcgttcaaggcggcgattgcgcatgctacccaagccgctgaggccgcccggtccgacccggccaaaccgggcacggcgccaacggttcgcccgccggcaccaccggtccggtgaccgcagtacggtccccccagcctgactaccgtgccccggcgggct

SEQ ID NO: 630 - DNA, 398 bp, Mycobacterium tuberculosis
tggccgggctggtagcccgcgtatggcaaggttccgctcaatgtggttgtgatgcagcaggactacgttcgcctcaatcagctcaaacgtcacccccgtggcgtgctgcgcagcatgaaggtcggcgcccgcacgatgtgggcgaaggcaacaggtaagaacctggtcggcatgggtcgagccctcattgggccgttgcggatcgggttgcagcgcgccggagtgccggtcgaactcaacaccgccttcaccgatcttttcgtcgaaaatggcgtcgtgtccggggtatacgtccgcgattcccacgaggcggaatccgctgagccgcagctgatccgggctcgccgcggcgtgatcctggcctgtggtggtttcgagcataacgagcagatgcgaat

SEQ ID NO: 631 - DNA, 464 bp, Mycobacterium tuberculosis
  modified_base (39): a, t, c or g
  modified_base (58): a, t, c or g
  modified_base (67): a, t, c or g
  modified_base (100): a, t, c or g
  modified_base (108): a, t, c or g
  modified_base (187): a, t, c or g
  modified_base (198): a, t, c or g
  modified_base (194): a, t, c or g
  modified_base (319): a, t, c or g
  modified_base (371): a, t, c or g
  modified_base (391): a, t, c or g
  modified_base (460): a, t, c or g
gtccagtcaagcatcggtcctctccgactacgccaagantggcgacgtgtcagtgcanacagcgganatggtggcgcctatgcgtcgacgctcacaaacngcggtgancgcgttctggtcgtgcaccatcgagccgtgccagcccggccgcgtgccgtcagccgcatccactggatgccttctcggngtttcaatcangtacangcgacgttcgccaccatcgtgccggggcacggttagcgagaaaccgccgacttcaccgattgcctcggtgatgccgtcgaacagatcgggcctattgtcgacagccagtgtgatncgtatttgccgccgtgctcctcgtcgcaacgatgcgaacacagatccgtggnggacgatagcggctgacaangtgggggcaacacaatcacatgccacatttcttcatttcacgcccacaacccagacttcgtctcgatgngccg

SEQ ID NO: 632 - DNA, 499 bp, Mycobacterium tuberculosis
  modified_base (103): a, t, c or g
  modified_base (255): a, t, c or g
  modified_base (336): a, t, c or g
  modified_base (342): a, t, c or g
  modified_base (368): a, t, c or g
  modified_base (417): a, t, c or g
  modified_base (499): a, t, c or g
cacgcggtctggcccgatccgaagatccctttgccggcgtggcggctctgctcggcggtgttgtacacttctcgaacacctcggcaccgacaccaccaccgtngcttgaacaccgccaacatcggcagcagatcttgatggtcctggtgaatcccacggtgactttggagtggaaggcgccatactgatcgccgcgccagcacatgagctagcggcaggaaaaccagcagccgctcaccttgcgcagcagcgtcnggtgatatgcctggcgcccttaatctcgtgaaccagttggattgggtcaactggcagccttgggtctccggtggtgccgangtgtanataagctcccgggtccgtcaacgtantgcgcaggcggcggttactcggcgggtcaacgagccccgctcgtgagcnatcagcctttggaccgaacgggattcatactccgcaggcggccctccgaaatcggcacatgtcctttgatcgttcgcaacan

SEQ ID NO: 633 - DNA, 343 bp, Mycobacterium tuberculosis
  modified_base (178): a, t, c or g
  modified_base (235): a, t, c or g
ggccatgtcacatcggtggtacaggtaaaccgcgccgtgtgcgcggtctcggagatcagaacgtggtcgcagttgaaccgcgggctttcagccagtcgcgataatcggcggaagtcggcgcctgccgccccaactagcgcgactcgccacctagcacaccgatggcgaaggccatgtntccggccacgccgccgcggtgcatcaccaagtcatcgactaggaagctaagcgacancttgtgcaggtgttcgggcagtagctgctcggaaaatcggctggaaaccgcatcaaatggtcggtccaatcgaaccggttacccgatcgtcacaaaaatctccgtcct

SEQ ID NO: 634 - DNA, 192 bp, Mycobacterium tuberculosis
gggtctacaaccaccgggtctgacttctgggcttccaccgctcgcgccgtcgcgacaaacagcgcggtcgaaccgacactcgttgtgatgtcccagctatcacctccggtaggcacccaatcgaccctacccggctatctcacccccgatctccaggctccgccgatccatgcgcatcccggtccggatccc

SEQ ID NO: 635 - DNA, 376 bp, Mycobacterium tuberculosis
caggcatgcaagcttgtcgtattccgtggcactgtcagacatatgcgccgctcctcctcatcgctgcgctcggcatcgtcgccggcggtcatggcgtcaccctacccaagccgaacgcgaaacgagaacgtgttccattattagggtgtgagcaccaataccagattgctcaccaggaactcacgcagcaccgggacggatgtcagccaccacgcccatctggggtggtagcggggaaatacggctaacgcggctccggtgccggcagcccagcgcagaccctcggcggcggacacggctaacaacgacgacccatagttgttctttgccggatggccgtgtttgctgacatatcgggcgcggcgccggcgccgcc

SEQ ID NO: 636 - DNA, 83 bp, Mycobacterium tuberculosis
  modified_base (1): a, t, c or g
  modified_base (32): a, t, c or g
  modified_base (61): a, t, c or g
nctacgctgctgaatgttgtgcgccggagganctcaagacccacgcggttgtacgcggacntgcgacatgttcaaccgccgga

SEQ ID NO: 637 - DNA, 319 bp, Mycobacterium tuberculosis
  modified_base (241): a, t, c or g
ctaaccaacaagccatggtggttggcgccgtcgagaggtcggcggtcgccacaacgggaagatcgccttgagcgtcgctcgaccgccgcctcgagttgggtcataacgaagtactgatgccgatcatgtcgacgtgtccgtcgcatcagcgtgcagcggcgacccctcgacgagcctcggtgccgccgcggccagggcaccagctgttttagcgcattgtgctccgccggtaataaaggangtcggtcgcctccgctgctgtggttgcggaataacatcttcccttcctgcaacaggatgagaatggttttaattgctc

SEQ ID NO: 638 - DNA, 94 bp, Mycobacterium tuberculosis
ctaagctttcgggtccgccgccactagtaccgcgttgccggccccgccgacctagaatgttccgcccattgccgtttcctcccgccgccgggtt

SEQ ID NO: 639 - DNA, 122 bp, Mycobacterium tuberculosis
tctggtgccgggtgtgccgacgggtccgtccgcctctgcttcagtgattctgtgatgcgaccggcaacgtcctcgttgttcggtgtctatgtggtccgtctctccttgttccgcatacgatt

SEQ ID NO: 640 - DNA, 210 bp, Mycobacterium tuberculosis
  modified_base (8): a, t, c or g
  modified_base (10): a, t, c or g
  modified_base (136): a, t, c or g
  modified_base (139): a, t, c or g
  modified_base (150)..(151): a, t, c or g
gcgatcgntnaccacaagggcgcaaccgttcgcgcgtcgactgaacgtgctgccgcctggagaactggcgctgctgccacctggtcggcgcatcggcacttcgaggactggatttcgacgcgtggcccgacctgangtnggcggtggacnngtgtgcacccggttgattcctcggccttgccgggatgccacctgcgcctggtggtcgat

SEQ ID NO: 641 - DNA, 328 bp, Mycobacterium tuberculosis
  modified_base (285): a, t, c or g
cgtgaccggacggggtgccgcgcgaaccggtcttggccaattgccggggactggggctggagtataaagcgggcctgttgccggaagataaagtcaaagcggtgaccgagctgaatcaacatgcgccgctggcgatggtcggtgacggtattaacgaccgccagcgatgaaagctgccgccatcgggattgcaatgggtagcggcacagactggcgctggaaaccgccgacgcacattaaccataaccacctgcgcggctggtgcaaatgattgaactggcacgnccactcacgccaatatccgccagaacatcactattgcgctggg

SEQ ID NO: 642 - DNA, 553 bp, Mycobacterium tuberculosis
  modified_base (21): a, t, c or g
  modified_base (236): a, t, c or g
  modified_base (251): a, t, c or g
  modified_base (473): a, t, c or g
atactcaagcttcttacccanagcatgaaccccgccgtccaatgccgccaccgtggtgctgtcggccggccgggtgcgggcacaatcgccgagttcggcgaacagatcctcgaaggtcttcacggccagcgattgttgcacgtgtcagccagccaagtcacggtggtttgacgccacacgttcgccaccgccgcgccgcgcattagggcatcctaatataggttaggctaccctanttattcctgtggtcnaaggaggcagccgaacgtgaccttcccgatgtggttcgcagttccgccggaagtgccgtcagcatggctgtccaccggcatgggccccggtccgctgctggccgcggccagggcgtggcacgcgctggccgcgcaatacaccgaaattgcaacggaactcgcaagcgtgctcgctgcggtgcaggcaactcgtggcaggggcccagcgccgacggttcgtcntccccatcaaccgttccgtattggctaaccacctgcacggtggcaccgcacaacgccgccacaaacgcgccccggtatac

SEQ ID NO: 643 - DNA, 486 bp, Mycobacterium tuberculosis
ggccgaacttaatcggttgttggcggctgccgagttgggtcactcggggggtgtgcactggcacatggtgggccggattcaacgcaacaaagccgggtcgctggctcgctgggcgcacaccgctcactcggtggacagctcgcggttggtgaccgcgctggatcgggcggttgttgcggcgctggccgaacaccgtcgtggcgagcggctgcgggtttacgtccaggtcagcctcgacggtgacggatcccggggcggcgtcgacagcacgacgcccggcgccgtagaccggatttgcgcgcaggtgcaggagtcagagggcctcgaactggtcgggttgatgggcattccgccgctggattgggacccgacgaagcctttgaccggctgcaatcggagcacaaccgggtgcgtgcgatgttcccgcacgcgatcggtctgtcgcgggcatgtccaacaacttgaaatcccgtcaacatggtcgac

SEQ ID NO: 644 - DNA, 146 bp, Mycobacterium tuberculosis
gcttcccctgatactcgaccagccccactcgggccaatacgtgaatgtcctagcatttttcacccgttcacgggctagtcgagtagtagacgattgattagcctgaacgtacctccgacggccagctgacgaacgggtttgacgga

SEQ ID NO: 645 - DNA, 204 bp, Mycobacterium tuberculosis
  modified_base (50)..(51): a, t, c or g
  modified_base (55): a, t, c or g
  modified_base (66): a, t, c or g
  modified_base (70): a, t, c or g
  modified_base (75): a, t, c or g
  modified_base (77): a, t, c or g
  modified_base (88): a, t, c or g
  modified_base (90)..(93): a, t, c or g
  modified_base (101): a, t, c or g
  modified_base (109): a, t, c or g
  modified_base (116): a, t, c or g
  modified_base (133): a, t, c or g
  modified_base (142): a, t, c or g
  modified_base (145): a, t, c or g
  modified_base (148): a, t, c or g
  modified_base (152): a, t, c or g
  modified_base (161): a, t, c or g
  modified_base (173)..(174): a, t, c or g
  modified_base (178)..(180): a, t, c or g
tcagctgtctgtagaagggctggcgatactgtgcactgtctgatatcgcnncgtngtgggactatncagnccatnangatgcggttcngnnnntgcagagnatcctggnacacatncggttcacgttaatcancatcgcganttnctncgtnttcgattanttctgctaacgnntctnnnagtgcctgcgggtcgactctagag

SEQ ID NO: 646 - DNA, 209 bp, Mycobacterium tuberculosis
  modified_base (1): a, t, c or g
  modified_base (13): a, t, c or g
  modified_base (55): a, t, c or g
  modified_base (64): a, t, c or g
  modified_base (74): a, t, c or g
  modified_base (76): a, t, c or g
  modified_base (87): a, t, c or g
  modified_base (104): a, t, c or g
  modified_base (153): a, t, c or g
  modified_base (169): a, t, c or g
  modified_base (193): a, t, c or g
  modified_base (198): a, t, c or g
  modified_base (200): a, t, c or g
  modified_base (207): a, t, c or g
  modified_base (209): a, t, c or g
nctctgccgggcnagagcgcagagtcggacggcttcgtcgatcgtgaagcgaccntgcgatgancagatatcgntnacactgctcanaaacttcggatcatcgntgatacacaggccaacgggtagcggttgtccaaccgcttcgtcaacganatgggatcgtgacgancctacgctcgcaggatatgtcgcngaccngntctaganan

SEQ ID NO: 647 - DNA, 183 bp, Mycobacterium tuberculosis
  modified_base (23): a, t, c or g
  modified_base (33): a, t, c or g
  modified_base (38): a, t, c or g
  modified_base (56): a, t, c or g
  modified_base (75): a, t, c or g
  modified_base (81): a, t, c or g
  modified_base (89): a, t, c or g
  modified_base (133): a, t, c or g
  modified_base (135): a, t, c or g
  modified_base (143): a, t, c or g
  modified_base (154): a, t, c or g
  modified_base (169)..(170): a, t, c or g
  modified_base (178): a, t, c or g
cacttcatgctcgtgcgttggcntcgatttgcncgagnggttagctcctcgagtgngtgacgtatcactccggcngactanccgtatcngcgtcccgcaccggtcaactggtctagccacaccggggagaatncncgaccggngctatcgaccnatcacggcttgtcgnnaagatagncagcc

SEQ ID NO: 648 - DNA, 154 bp, Mycobacterium tuberculosis
atactcaagcttgccaaccgccaccctgcatccggggggcgagcactgctccgccgaccagtacgaaccaacctgcggtgcccaggccattgacaatgtgctggtcggcgcccgcgagttctagcacagcaacgccgcggccaccacaggggcg

SEQ ID NO: 649 - DNA, 219 bp, Mycobacterium tuberculosis
cggtcggtgtgcttggcggcgtcggtatcaacaccgcccacgaaatggggcacaagaaggattcgctggagcggtggctgtccaagatcaccctcgcccagacctgctacgggcacttctacatcgagcacaaccgtggccatcacgtccgggtgtccacaccggaagacccggcgtcggcgcggttcggcaaaactttgtgggatttcccgccccccc

SEQ ID NO: 650 - DNA, 307 bp, Mycobacterium tuberculosis
aatactcaagcttcgcggaggtggtggggcaggagcacgtcaccgcgccgctgtcggtggcgctggatgccggccggatcaaccacgcgtacctgttctctgggccgcgtggctgcggaaagacgtcgtcagcgcgtatcctggcgcggtcgttgaactgtgcgcagggccctaccgccaacccgtgcggggtctgcgaatcctgcgtttcgttggcgcccaacgcccccggcagcatcgacgtggtagagctggatgccgccagccacggcggcgtggagcaaccccgcgagctgcgggaccgccc

SEQ ID NO: 651 - DNA, 252 bp, Mycobacterium tuberculosis
gatggcactcacgctggacaagaccttcacaaaatctgaaatcctgacccgatacttgaacctggtctcgttcggcaataactcgttcggcgtgcaggacgcggcgcaaacgtacttcggcatcaacgcgtccgacctgaaattggcagcaaaccggcgctgctgggccgggcatggtgcaatccgaacaagcacgctcaacccgtacaccaaccccgaagggccgctggcccggcggaaccttgtcctcca

SEQ ID NO: 652 - DNA, 402 bp, Mycobacterium tuberculosis
  modified_base (207): a, t, c or g
  modified_base (232): a, t, c or g
  modified_base (316): a, t, c or g
  modified_base (322): a, t, c or g
  modified_base (324): a, t, c or g
  modified_base (330): a, t, c or g
  modified_base (342): a, t, c or g
  modified_base (348): a, t, c or g
  modified_base (351): a, t, c or g
  modified_base (365): a, t, c or g
  modified_base (370): a, t, c or g
  modified_base (390): a, t, c or g
aacagctatgaccatgattacgccaagctatttaggtgacactatagaatactcaagcttctgggcgtcgtggtgcccggcctgccggtgcaggaactggattttactgccatctctcgcgaccctgaggtggtccaggcttacaacaccgacccactcgtgcaccacggacgggttccggccgggattggccgcgcgctgctgcangtgggcgagaccatgccgcggcgancaccggcattgaccgcgccgctgctagtgctgcacggcaccgatgaccggctgatccccatcgaaggcagccgtcgcctggtcnaatgtntnggatcngccgacgtgcanctgaangantatccccggctgtnccacnaggtgttcaacgaaccggancgcaaccaagtg

SEQ ID NO: 653 - DNA, 429 bp, Mycobacterium tuberculosis
  modified_base (181): a, t, c or g
  modified_base (304): a, t, c or g
  modified_base (379): a, t, c or g
caaggcatacgccaagacccaagggatcgcagtcacctccgtcaacggcctggtcgccggccacgggtccgtgcaggagacgtggctggccatgcaaagcgccgccgccttatcaggaacgccccggcttgtcggcttttcctgcatcgacacatttccggaggtgttgtggttggcgcancgcgcgagacaggcctgggatggcgtgcgcatcgtcatcgggaatgcgatggcaacactgaactacgagcgcatcctgcgccagcatgactgtttcgactacgtcgtcgttggcgacggggangtagcgttcaccaagctggccttggccctggcgaatgacctgcggttgacgactcccgggactaacccgccgtantgagcaaggacagattctgcgcacaccctcctcgctggtcgaccttgaca

SEQ ID NO: 654 - DNA, 353 bp, Mycobacterium tuberculosis
  modified_base (109): a, t, c or g
  modified_base (151): a, t, c or g
  modified_base (208): a, t, c or g
  modified_base (247): a, t, c or g
  modified_base (265): a, t, c or g
  modified_base (300): a, t, c or g
  modified_base (307): a, t, c or g
  modified_base (345): a, t, c or g
aacagctatgaccatgattacgccaagctatttaggtgacactatagaatactcaagcttgccggtgatctgggtggccaactcggcgggcaccatctccatcacgacngcaaacgctccggcttcggcgacagcgatcgcgtctgcgatngtttgttcggcggcgtctccgcggccctgcacccggaagccgcccaaggtgttgacnctttgcggggtgaagccgatgtgtgccatcaccgggatncccgccgcggtcagacangcgatttgctcggccacccgctcaccgccctcgancttgacngcatgtgcgccgccgtccttgaagaaaccggtggcggnggcaaccc

SEQ ID NO: 655 - DNA, 464 bp, Mycobacterium tuberculosis
  modified_base (435): a, t, c or g
cgttgagatccagctgcgcactgtgcagcgcctcggtggtctgctcggcctgccgggataactcgttgagcttggccagcgcgtcgtcggccggatcagccagcacattcgcggccaggacgccggaggagacggtgaagctcgcaaagaaacctatggcggaccgcatgattacacgcgcgatcaaccacctctggtcgagcctcaaaatttgcttccttaaacgggccatcgacggatgacgtcgagctggtttaggtctcaaacaggttacgaaacgatctcggaattgtccaaaaggggaagttaagaaaatggatagatttctaccatttcgctgtggacgatcgtacttctgctatagggctccaggggcatcgacacgcaacgaccttacgcgacaccggatccgcgctggcggcggaacggcaccangcgcaaccgaagggccaatccgacatcgg

SEQ ID NO: 656 - DNA, 515 bp, Mycobacterium tuberculosis
  modified_base (140): a, t, c or g
  modified_base (257): a, t, c or g
atactcaagcttatctaggcgccagcttgattggtctggttgcattggccagctgcgcgagcctggctcacttcaactacaacaaccgcaaacaattgccgccttcggatccgagttcggttgggtacgcggcaatggancaccatttctcggtgaatcagactattcctgagtacttgatcatccactctgcacacgacctgcgaaccccgcgcggccttgccgacctggagcagctggcgcaacgtgtgagccanatcccaggcgttgccatggttcgcggtgtgacccggccaaacggggaaacccttgaacaggcccgggcgacataccaagccggccaagttggcaaccggctgggcggcgcgtcgcgaatgatcgatgagcgcaccggcgacctgaatcggctggcatcgggtgccaacctgttggccgacaatctcggtgacttcgcggtcaagtcagccgggccgttgcgggtgtccgcagccttgtccagcccctcgcttactcca

SEQ ID NO: 657 - DNA, 403 bp, Mycobacterium tuberculosis
caggcatgcaagctttttgagcgtcgcgcggggcagcttcgccggcaattctactagcgagaagtctggcccgatacggatctgaccgaagtcgctgcggtgcagcccaccctcattggcgatggcgccgacgatggcgcctggaccgatcttgtgccgcttgccgacggcgacgcggtaggtggtcaagtccggtctacgcttgggcctttgcggacggtcccgacgctggtcgcggttgcgccgcgaaagcggcgggtcgggtgccatcaggaatgcctcaccgccgcggcactgcacggccagtgcccgcggcgattcagccatcgggacatcatgctcgcttcatactcctcgaccagtcggcggaacagctcgattcccggaacgcccacgcatggtg

SEQ ID NO: 658 - DNA, 444 bp, Mycobacterium tuberculosis
  modified_base (296): a, t, c or g
  modified_base (314): a, t, c or g
  modified_base (367): a, t, c or g
  modified_base (377): a, t, c or g
  modified_base (394): a, t, c or g
  modified_base (410): a, t, c or g
aacagctatgaccatgattacgccaagctatttaggtgacactatagaatactcaagcttgtagaaaaagatcggtgagcgcatcgattcgctccgccgggtttgccgctgcggcggcggagctgccgtgaccgtctatttgggtgatcagatactgggctagttcggtcggggtggggtgatcgaagatcgcggtggccggcagcgttactgcggtgacagctgttaagcggttacgtatctccacggcactcaaggaattaaatcccgaatcggcaaacgcctggccagcgtcnagtccggcagcgccgtcncgccccagcaccgctgcggcatgctcacataccacctcgatcgctgcggcganttgctcgtcngccgaccgaccggccanccgggcggcaaacccngaagacccaagaattcatcaccaccatcgctagc

SEQ ID NO: 659 - DNA, 437 bp, Mycobacterium tuberculosis
  modified_base (188): a, t, c or g
  modified_base (203): a, t, c or g
  modified_base (257): a, t, c or g
  modified_base (265): a, t, c or g
  modified_base (287): a, t, c or g
  modified_base (312): a, t, c or g
  modified_base (322): a, t, c or g
  modified_base (349): a, t, c or g
ccttcttgacacccacctcgccatcgaccttgagcactccgtcgtagttggtgaacatgtgaccggcgatcgggcgggtgaacgcgtactgggtgtcggtgtcgacgttcatcttcaccacgccgtagcgcagcgcctcctcgatctccgacttaagcgaacccgagccgccgtggaacacgaaatcnaacggcttggcgtcngccggcagtccgagcttggccgccgccacctgttgcccttgcgcaaggatgtcngggcgaancttgacgttgccgggcttgtanacgccatgcacgttgccgaacgtcncggccagcangtatttgccgtgctcaccggcgcccancgcctcgatggttttctcgaagtcctccgggctggtgtacagcttctcgttgatctcgttcgccacgccgtcctcttcgccgccgacg

SEQ ID NO: 660 - DNA, 422 bp, Mycobacterium tuberculosis
  modified_base (132): a, t, c or g
  modified_base (195): a, t, c or g
  modified_base (216): a, t, c or g
  modified_base (219): a, t, c or g
  modified_base (237): a, t, c or g
  modified_base (279): a, t, c or g
  modified_base (297): a, t, c or g
  modified_base (303): a, t, c or g
  modified_base (335): a, t, c or g
  modified_base (356): a, t, c or g
  modified_base (366): a, t, c or g
  modified_base (395): a, t, c or g
  modified_base (410): a, t, c or g
  modified_base (414): a, t, c or g
aacagctatgaccatgattacgccaagctatttaggtgacactatagaatactcaagcttggaaaggagatccccgggaacctggtggcaaccccgccattggggttgttgggattgccgatcagcgtgaangaaagctcgtctggagacagcgggtcggccgaagccgcaagattggccatcactagtgacganatcgtggcgctctgcgagtanccnaagacagtgacgttgttnccggcggcaatttgctgccgaatcgcactttcgagaatgacngcaccctgcgccaccgangaatcnaaagtgaggttcttgatcacgaccaccgggtngagcccttggggcgtgaagancgcctgcgcnataacacccgggacgctgccactcatgtncagcgcgttcgcganctcnacatatct

SEQ ID NO: 661 - DNA, 412 bp, Mycobacterium tuberculosis
  modified_base (14): a, t, c or g
  modified_base (70): a, t, c or g
  modified_base (269): a, t, c or g
tcctggtgatcganggccgcggttccggccgaaaatccggttcgggttcgggtcgcggttccaacttgancgcggtccgcagctgattcaccgtggcaacgccggccaactgcgcataatgcgcatccgaaccctcacccgcccgccccgcgatcaccccaacctgatccaacgacaaccgcccctcccgcataccccgggcgcagcgcggaaactccggcaaccgccgcgccaccgtggcgatcgtgtgggcgttgcctgacgaacancccatcttccaggccaccaaccccgccaccgaccgcgcccccgtcacaccccacaacccgtcgcgatccagctcagccacgatctccacaatgcgcccatcaatcgcattgcgctgaacgggcaactccgccaactcctccaa

SEQ ID NO: 662 - DNA, 467 bp, Mycobacterium tuberculosis
aacagctatgaccatgattacgccaagctatttaggtgacactatagaatactcaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaa

SEQ ID NO: 663 - DNA, 452 bp, Mycobacterium tuberculosis
  modified_base (62): a, t, c or g
  modified_base (97): a, t, c or g
  modified_base (147): a, t, c or g
  modified_base (189): a, t, c or g
  modified_base (200): a, t, c or g
  modified_base (202): a, t, c or g
  modified_base (210)..(211): a, t, c or g
  modified_base (223): a, t, c or g
  modified_base (226): a, t, c or g
  modified_base (228): a, t, c or g
  modified_base (237): a, t, c or g
  modified_base (244): a, t, c or g
  modified_base (268): a, t, c or g
  modified_base (279): a, t, c or g
  modified_base (297): a, t, c or g
  modified_base (325): a, t, c or g
  modified_base (336): a, t, c or g
  modified_base (340): a, t, c or g
  modified_base (344): a, t, c or g
  modified_base (350): a, t, c or g
  modified_base (388): a, t, c or g
  modified_base (419): a, t, c or g
  modified_base (427): a, t, c or g
  modified_base (434): a, t, c or g
  modified_base (448): a, t, c or g
aacagctatgaccatgattacgccaagctatttaggtgacactatagaatactcaagcttancgccacctcccgggcggaactccacggcgtggatnaaggtaccggccgggatgttgcgcaatggcaggttgttgcccggcttgangtccgcgttagcgccggattccaccacatccccttgcgaaantccgttgggtncnatgatgtnncgcttctccccntcnanataatggancaacgcnatccgtgcggtacggttcgggtcntactccatgtncgcgaccttggcgttganaccatctttgtcattgcggcgaaagtcnatcatccggtnagcncgcntatgancgccgcctttgtgccgggtggtaatccggccatgcgcnttgcgtccaccgcgaacgtgcaacgggggcnccaacganttctccngggttgaaccggtnatct

SEQ ID NO: 664 - DNA, 93 bp, Mycobacterium tuberculosis
tgtgtgtggtggtaacccatctgagcagtgtgccaaaccggggcagccagctcccaattgacgtgagcccgctcacttgctgggtaagcgtcg

SEQ ID NO: 665 - DNA, 352 bp, Mycobacterium tuberculosis
  modified_base (47): a, t, c or g
  modified_base (67): a, t, c or g
  modified_base (70): a, t, c or g
  modified_base (100): a, t, c or g
  modified_base (118): a, t, c or g
  modified_base (137): a, t, c or g
  modified_base (171): a, t, c or g
  modified_base (175): a, t, c or g
  modified_base (182): a, t, c or g
  modified_base (188): a, t, c or g
  modified_base (193): a, t, c or g
  modified_base (218): a, t, c or g
  modified_base (221): a, t, c or g
  modified_base (231): a, t, c or g
  modified_base (250): a, t, c or g
  modified_base (265): a, t, c or g
  modified_base (271)..(272): a, t, c or g
  modified_base (278): a, t, c or g
  modified_base (304): a, t, c or g
  modified_base (306): a, t, c or g
  modified_base (312): a, t, c or g
  modified_base (324): a, t, c or g
  modified_base (342): a, t, c or g
aacagctatgaccatgattacgccaagctatttaggtgacactatanaatactcaagcttgcgggtnatngccttggtcaacggcaccgtgatcggatcngggtctaccgcacacatngactggagcttcggcgaantcatcgcctatgcctcgcggggggtgacgctgancccnggtgacntgttcngctcnggcacggtgcccacctgcacgctcntcnaacacctcangccaccggaatcattcccnggctggctgcacganagcgannttgtcnccctccaagtctaaaggctgggcgananaagcanaacgtcccgacnaacggcactccttttccntttgctcttc

SEQ ID NO: 666 - DNA, 448 bp, Mycobacterium tuberculosis
  modified_base (232): a, t, c or g
  modified_base (289): a, t, c or g
  modified_base (353): a, t, c or g
  modified_base (390): a, t, c or g
gaaatcattgatggtttgagtcaccaggccgatcaagccttcgccgagccaaattccaatcaagaggcccaagcccgtaccaatcagcccggcaacgagggattccgtcattatcagccaaaataactgctctcgggttacacccaaacagcgcaatatggcgaaaaacggtcgccgttgcacgacattaaatgtcacggtattgtagattaaaaagatacccaccaacaangcaatcaaactgagagcggttaaattgaccgtaaaagcgtccgtcatctgtttgacngtgtcccgttgggtatccgacgtttccatacgcacaccggccggcagtctttgttggatgcgtnttgcaatggcctcatctttgatgatcaaatcgatgtngctcagtcttccgggcatatggaacaactcttgggccgtggaaatatcagcaatgata

SEQ ID NO: 667 - DNA, 386 bp, Mycobacterium tuberculosis
  modified_base (242): a, t, c or g
ctttcgcccaggccggcgcggatgtcctcatcgcttcacgaacatcatccgagcttgacgctgtcgccgaacagatccgcgctgccggccgccgcgcccacaccgttgccgccgatctggcccatcccgaggtgaccgcgcagctggctggtcaggccgtcggagctttcgggaagctcgacatcgtcgtcaacaacgttggcggcaccatgcccaacacgctgctaagcacctcgaccaangacctcgcggacgccttcgccttcaacgtgggcaccgcccacgcgctgaccgtcgcggcggtgccgttgatgctggaacactccggcggcggcagcgtgatcaacatcagctccaccatgggccggctggcggcgcggggtttc

SEQ ID NO: 668 - DNA, 378 bp, Mycobacterium tuberculosis
  modified_base (153): a, t, c or g
  modified_base (168): a, t, c or g
  modified_base (267): a, t, c or g
  modified_base (302): a, t, c or g
tgtgggctccgatccggcgcgcatggcatcgacggcgacgccgatcgatgacggccaggcttacgagcttgagggtgtgaagttgtggaccaccaacggtgtggtagcggacctgctagtggttatggcgcgggtaccgcgcagtgaagggcnccgagggggaatcancgcctttgtcgtcgaggctgattcgcccgggatcaccgtggagcggcgcaacaagttcatgggactgcgtggcatcgaaaacggcgtgacccggcttcntcgcgtcagggtgcccaaagacaacttgatcgcanggaagcgacggtctgaagatcgcgctgaccacactcaacgccggacggctgtccctaccggcgatccaaccggagt

SEQ ID NO: 669 - DNA, 344 bp, Mycobacterium tuberculosis
  modified_base (285): a, t, c or g
gagctggccgagctggaccggttcaccgcggaactaccgttctcgctcgacgactttcagcagcgggcttgcagcgcgctggaacgcggccacggtgtgctggtgtgcgcgccgaccggcgctggcaagacagtggtcggcgagttcgccgtgcacctggcgctggcggccggcagtaaatgtttctacaccacgccgctgaaagccctgagcaaccaaaagcacaccgatctcacagcacgctacggccgtgaccagatctggctgctgaccggtgacctgtcngtcaacggcaaccgccggtggtggtgatgaccaccgaaatgctgcgcaacatgctctac

SEQ ID NO: 670 - DNA, 411 bp, Mycobacterium tuberculosis
  modified_base (134): a, t, c or g
  modified_base (179): a, t, c or g
  modified_base (183): a, t, c or g
  modified_base (188): a, t, c or g
  modified_base (215): a, t, c or g
  modified_base (218): a, t, c or g
  modified_base (271): a, t, c or g
  modified_base (332): a, t, c or g
  modified_base (396): a, t, c or g
gatctctggatcggcggggctctccgggccggcctcggcgacctcagcgggccgcgccttccggccgaaccattccctagccatagatgaccgcacctcgatgcacggtttggcggcaacgcggcaaggcgtcngtcgggcccagccgcggcaatgcgggtacccgggagcgcgggtcngtanaccancgctggactgcgtcgcgcggtgcgtcnacntcaaagtccccggcgtcccatatcgcgtatgacgcgggcgcgcccggcaccangggtgccgatccggccgtctcgaacaccaccggcccgccagccgccgcgggtccggcagcnaacccgcccgcgccgatacccgctgcccgcgtgcgtgattgaccgccgcgcgcacgctggccanggatcaaagcccgtg

SEQ ID NO: 671 - DNA, 473 bp, Mycobacterium tuberculosis
  modified_base (147): a, t, c or g
  modified_base (247): a, t, c or g
  modified_base (380): a, t, c or g
  modified_base (457): a, t, c or g
  modified_base (468): a, t, c or g
ggacgcgtagcccgccaggccggtcagggtgcccttccagtccacgccgctgtggtcggcgaaccgcttatcttcaatcgagacgatcgccagcttcatcgtgttggcgatcttgtccgagggcacctcgaaccggcgctgcgagtncagccacgcgatcgtgttgcccttcgcgtcgaccatcgtcgataccgcaggcacttgcccctcgagcagctgggccgagccgttggcaacgacctcagangcacgattggacatcagccctagcccgcctgcgaacgggaacgtcagcgcagtggcgacgacactggccaacagacagcacccagccagcttcagaacggtgatcgcggccgggaagcgctcgggcatgcgtnctacagtagcgacctcctgtcactccacgtgccgctcggtccaatagaatctttccgcgggcgggtgaatctctgcnggatcggggcnggcgc

SEQ ID NO: 672 - DNA, 357 bp, Mycobacterium tuberculosis
  modified_base (151): a, t, c or g
  modified_base (185): a, t, c or g
  modified_base (242): a, t, c or g
  modified_base (247)..(248): a, t, c or g
  modified_base (293): a, t, c or g
gctcgttgccggcggcgatctcgtcgagctcgtcttccatcgccgcggtgaagtcgtagtcgacgagccgaccgaaatgctgctcgagcagaccggttaccgcgaacgccacccatgacggcaccagtgcactgcccttcttgtgcacgtngccgcgatcctggatggtcttgatgatcgacgantaggtcgacgggcggccgatgcccagctcctcgagcgctttgaccagcgacgcctcngtgtnncgggccggcgggttggtggcatggccgtctggggtcaactcgacnatgtccaaccgttgacccggggtcagatggggcagtcgccgctcggcatcgtcagcctcgccgc

SEQ ID NO: 673 - DNA, 402 bp, Mycobacterium tuberculosis
  modified_base (222): a, t, c or g
  modified_base (227): a, t, c or g
  modified_base (240): a, t, c or g
  modified_base (247): a, t, c or g
  modified_base (270): a, t, c or g
  modified_base (369): a, t, c or g
gtctttcgatggctgcttcttcggcgctgacgctggcgatctatcacccccagcagttcgtctacgcgggagcgatgtcgggcctgttggacccctcccaggcgatgggtcccaccctgatcggcctggcgatgggtgacgctggcggctacaaggcctccgacatgtggggcccgaaggaggacccggcgtggcagcgcaacgacccgctgttgaacgtcnggaanctgatcgccaacnacacccncgtctgggtgtactgcggcaacngcaagccgtcggatctgggtggcaacaacctgccggccaagttcctcgagggcttcgtgcggaccatcaacatcaagttccaagacgcctacaacgccngtggcggccacaaccgcgtgttcgacttcccgg

SEQ ID NO: 674 - DNA, 336 bp, Mycobacterium tuberculosis
  modified_base (57): a, t, c or g
  modified_base (156): a, t, c or g
  modified_base (189): a, t, c or g
  modified_base (300): a, t, c or g
  modified_base (303): a, t, c or g
gccaggtcgaggtcccatgcgcgtgggccattgatgctgatcgccaggacgtcaaanatttggtccggcgtcagctgggcgaaaaacgtgggccccaggacttgcccggagctgcccgggttcccgtcgcgcagctcggcggccccggtcagaaanaaattgcgccaggtcgcacactccgcgccgtangccagctgctccagggtgtcggcatagagcccgcgggccgcagcgtgctcgctgtcggcgaacaccgcatggtcgagaagcgttgccgcccaacggaaatcacctgcgtcnaangcttcgcgggccaactccagcactcggtcgatg

SEQ ID NO: 675 - DNA, 405 bp, Mycobacterium tuberculosis
  modified_base (1): a, t, c or g
  modified_base (16): a, t, c or g
  modified_base (51): a, t, c or g
  modified_base (82): a, t, c or g
  modified_base (84): a, t, c or g
  modified_base (94): a, t, c or g
  modified_base (110): a, t, c or g
  modified_base (112): a, t, c or g
  modified_base (119): a, t, c or g
  modified_base (137): a, t, c or g
  modified_base (153): a, t, c or g
  modified_base (155): a, t, c or g
  modified_base (171): a, t, c or g
  modified_base (173): a, t, c or g
  modified_base (210): a, t, c or g
  modified_base (239): a, t, c or g
  modified_base (249): a, t, c or g
  modified_base (283): a, t, c or g
  modified_base (288): a, t, c or g
  modified_base (297): a, t, c or g
  modified_base (299)..(300): a, t, c or g
  modified_base (311): a, t, c or g
  modified_base (326): a, t, c or g
  modified_base (330): a, t, c or g
  modified_base (336): a, t, c or g
  modified_base (349): a, t, c or g
  modified_base (352): a, t, c or g
  modified_base (364)..(365): a, t, c or g
  modified_base (375): a, t, c or g
  modified_base (381): a, t, c or g
  modified_base (393): a, t, c or g
  modified_base (405): a, t, c or g
naaacgttccggcttnggtgccgggcgcttatttgcgtctctgggatcacnctcagtcgccggcggctgccgttgggctatnanttgcaccganccggaaaatccgcacnanaactgcnagtagcggcctgcagaantgcatcctcggcgaancngactaccggtggacancnacaagcgccgccgaacaacgcactggcccgagggatnggcgtctatcggccccgcccgtcgaactnggaacagacngtgcggttctaccgtgatctggtgggaatgctcnaccanaccttcccnanngctacggaacnacggcgcgatattcngccntcccanctcgagcctgacnctngatatcgtcgannctcaccatcncgatcngctgtgccggtnttgctcggactn

SEQ ID NO: 676 - DNA, 389 bp, Mycobacterium tuberculosis
  modified_base (13): a, t, c or g
  modified_base (16): a, t, c or g
  modified_base (85): a, t, c or g
  modified_base (93): a, t, c or g
  modified_base (111): a, t, c or g
  modified_base (136): a, t, c or g
  modified_base (140): a, t, c or g
  modified_base (154)..(155): a, t, c or g
  modified_base (182): a, t, c or g
  modified_base (184): a, t, c or g
  modified_base (193): a, t, c or g
  modified_base (199): a, t, c or g
  modified_base (207): a, t, c or g
  modified_base (222): a, t, c or g
  modified_base (228): a, t, c or g
  modified_base (235): a, t, c or g
  modified_base (243): a, t, c or g
  modified_base (248): a, t, c or g
  modified_base (258): a, t, c or g
  modified_base (263): a, t, c or g
  modified_base (282): a, t, c or g
  modified_base (289): a, t, c or g
  modified_base (293)..(294): a, t, c or g
  modified_base (298): a, t, c or g
  modified_base (312): a, t, c or g
  modified_base (317): a, t, c or g
  modified_base (326): a, t, c or g
  modified_base (331): a, t, c or g
  modified_base (371): a, t, c or g
  modified_base (389): a, t, c or g
cgaacgacgaacnccncaagccatggtggttggcgccgtcaaaaggtccgcggtcgccactactggaaaatcgccttgagcgtcnctcgaccnccgcctcgagttgggtcntaacgaaatacctgatgccgatcangtcnacgtctccgtcgcnncaacgtgcagcggcgacccactctacnangtctcggtnccgccncggccagngcaccaccagtgacnaatccntgcgccntcgggccnagcantcccggtgcnaccgnggtgggtccggcgatggtngggtgtnctcnntacnggaacgccagcgcnatcancatcggcanactcncgtcgatgtgccgcggcgcaaccatcccccacaatgatcnggtgcgtctgatcaggcn

SEQ ID NO: 677 - DNA, 135 bp, Mycobacterium tuberculosis
ttaggcgtgacggccaccggggccactccgcacaatctgtacccgaccaagatctacaccatcgaatacgacggcgtcgccgactttccgcggtacccgctcaactttgtgtcgaccctcaacgccattgccggc

SEQ ID NO: 678 - DNA, 140 bp, Mycobacterium tuberculosis
cgtcaccccgatgcgcccagatcggggcttcgcagataaagcacgaactggcgggcaaaacgtcgatctcggagccggaagggcaatcagccgaccgtcgacgaacgacaccggcgagaccacttaggcagtgacggcct

SEQ ID NO: 679 - DNA, 272 bp, Mycobacterium tuberculosis
  modified_base (7): a, t, c or g
  modified_base (22): a, t, c or g
  modified_base (25): a, t, c or g
  modified_base (27): a, t, c or g
  modified_base (35)..(36): a, t, c or g
  modified_base (40): a, t, c or g
  modified_base (42): a, t, c or g
  modified_base (44): a, t, c or g
  modified_base (46): a, t, c or g
  modified_base (56): a, t, c or g
  modified_base (58): a, t, c or g
  modified_base (61): a, t, c or g
  modified_base (69): a, t, c or g
  modified_base (74): a, t, c or g
  modified_base (76): a, t, c or g
  modified_base (105): a, t, c or g
  modified_base (119): a, t, c or g
  modified_base (125): a, t, c or g
  modified_base (130): a, t, c or g
  modified_base (132): a, t, c or g
  modified_base (147): a, t, c or g
  modified_base (149): a, t, c or g
  modified_base (157): a, t, c or g
  modified_base (164)..(165): a, t, c or g
  modified_base (169): a, t, c or g
  modified_base (175): a, t, c or g
  modified_base (181): a, t, c or g
  modified_base (191): a, t, c or g
  modified_base (196): a, t, c or g
  modified_base (200): a, t, c or g
  modified_base (218): a, t, c or g
  modified_base (227): a, t, c or g
  modified_base (231)..(232): a, t, c or g
  modified_base (237): a, t, c or g
  modified_base (244): a, t, c or g
  modified_base (254): a, t, c or g
  modified_base (256): a, t, c or g
  modified_base (271): a, t, c or g
cttttcncgatgtctcatgatnccnanggagaacnntgcnancncngccgctgacntngcncaccgctntggcngnggtgacattggtggtggttgcgggctgcnacgcccgactcgangccganccatntnttgcggccgaccgcntntcgtctcnaccgcanncccnatctcngccgcncccggtgganctacngctncttcgccatctctcgccnatggctccngcgnntcgcncaacgtntggtttggtnanctgcctacctggtcnt

SEQ ID NO: 680 - DNA, 507 bp, Mycobacterium tuberculosis
  modified_base (39): a, t, c or g
  modified_base (172): a, t, c or g
  modified_base (175): a, t, c or g
  modified_base (180): a, t, c or g
  modified_base (239): a, t, c or g
  modified_base (241): a, t, c or g
  modified_base (255): a, t, c or g
  modified_base (258): a, t, c or g
  modified_base (287): a, t, c or g
  modified_base (310): a, t, c or g
  modified_base (348): a, t, c or g
  modified_base (350): a, t, c or g
  modified_base (367): a, t, c or g
  modified_base (373): a, t, c or g
  modified_base (402): a, t, c or g
  modified_base (404): a, t, c or g
  modified_base (416): a, t, c or g
  modified_base (430): a, t, c or g
  modified_base (447): a, t, c or g
  modified_base (475)..(476): a, t, c or g
  modified_base (478): a, t, c or g
  modified_base (482): a, t, c or g
gctgcgccagtcgttcggtgcggtcatgccgttggaccnaccatcggagttagttgccgaaccgcggaccaccgcaagcacccggtcctggtcgcgcaccgcgtcggccaaccgcttgagcaccaccacgccgcagccctcgccgcgcacgaatccatccgcgttggcgtcnaanctgtngcatcggtcggtcggtgacagcgccgaccacttggacagcgcgatggcggtgaacggtnantaggtgacctgccnccncgcccgccaatgcccacctccgcttcacncatgcgaatggtctgacacgccnagtgaattgccaccagcgacaacaaaaatcggtatctncngcgacggcggacacgcnatcccnactgatactcgatccgccccaccgcttgnanctccgggttccngtgctcatgtaccntcatgtcggtctgcgcncgatattgacgatcgtgtttcccacgannanagancctcatcacgccggttcgagtgccg

SEQ ID NO: 681 - DNA, 470 bp, Mycobacterium tuberculosis
  modified_base (11): a, t, c or g
  modified_base (81): a, t, c or g
  modified_base (129): a, t, c or g
  modified_base (139): a, t, c or g
  modified_base (166): a, t, c or g
  modified_base (196): a, t, c or g
  modified_base (215): a, t, c or g
  modified_base (231): a, t, c or g
  modified_base (253): a, t, c or g
  modified_base (262): a, t, c or g
  modified_base (265): a, t, c or g
  modified_base (267): a, t, c or g
  modified_base (269): a, t, c or g
  modified_base (294): a, t, c or g
  modified_base (316): a, t, c or g
  modified_base (319): a, t, c or g
  modified_base (343): a, t, c or g
  modified_base (346)..(347): a, t, c or g
  modified_base (364): a, t, c or g
  modified_base (377): a, t, c or g
  modified_base (419): a, t, c or g
  modified_base (427): a, t, c or g
  modified_base (435): a, t, c or g
  modified_base (437)..(438): a, t, c or g
  modified_base (441): a, t, c or g
  modified_base (446): a, t, c or g
  modified_base (452): a, t, c or g
  modified_base (461): a, t, c or g
  modified_base (463): a, t, c or g
ctgtgtgcggncggcgcgatatcggcctttttactaaccgaacccgatgtgggctccgatccggcgcgcatggcatctacngcgacgccgatcgatgacggccaggcttacgagcttgagggtgtgaanttgtggaccnccaacggtgtggtagcggacctgctantggttatggcgcgggtaccgcgcagtgaanggcaccgagggggaatcancgcctttgtcgtctangctgattctcccgggatcaccntggagcgcnccncnanttcatgggactgcgtggcatccaanacggcgtgaccggcttcatccntcngggtgcccaaagacaacttgatcngcnnggaagcgacgtctgaanatcgcgctgatcncactcaacgccggacgctgtcctaccggcgatcgcaccgganttgccaanccgcgctnannatncgcgngaatgnccgtccacnantgcatgg

SEQ ID NO: 682 - DNA, 346 bp, Mycobacterium tuberculosis
  modified_base (96): a, t, c or g
  modified_base (129): a, t, c or g
  modified_base (176): a, t, c or g
  modified_base (232): a, t, c or g
  modified_base (236): a, t, c or g
  modified_base (273)..(274): a, t, c or g
  modified_base (281): a, t, c or g
  modified_base (299): a, t, c or g
  modified_base (310): a, t, c or g
tggggtgccgggcgccgagttgcgtccctgggatcacgcagagtcgccggcggctgccgttgggctatgaattgcaccgagccggaaaatccgcancaaaactgcgagtagcggcctgcagaagtgcancctcggcgaaacggagtacggtggacaacgaaaagcgccgccgaacnacgcactggcccgagggattggcgtcaatcggccccgcccgtcgaacttggaaganacantgcggttctaccgtgatctggtgggaatgctccaacnnaccttcnccgaaagctacggaagcnacggcgcgatnttcggccttcccagctcgacctgacgctggaaatcg

SEQ ID NO: 683 - DNA, 453 bp, Mycobacterium tuberculosis
  modified_base (1): a, t, c or g
  modified_base (5): a, t, c or g
  modified_base (30): a, t, c or g
  modified_base (37): a, t, c or g
  modified_base (41): a, t, c or g
  modified_base (44): a, t, c or g
  modified_base (47): a, t, c or g
  modified_base (53)..(54): a, t, c or g
  modified_base (60): a, t, c or g
  modified_base (80): a, t, c or g
  modified_base (85): a, t, c or g
  modified_base (94): a, t, c or g
  modified_base (96): a, t, c or g
  modified_base (113): a, t, c or g
  modified_base (128)..(129): a, t, c or g
  modified_base (132): a, t, c or g
  modified_base (152): a, t, c or g
  modified_base (155): a, t, c or g
  modified_base (167): a, t, c or g
  modified_base (169): a, t, c or g
  modified_base (186): a, t, c or g
  modified_base (225): a, t, c or g
  modified_base (230)..(231): a, t, c or g
  modified_base (242): a, t, c or g
  modified_base (246): a, t, c or g
  modified_base (262): a, t, c or g
  modified_base (286): a, t, c or g
  modified_base (298): a, t, c or g
  modified_base (329): a, t, c or g
  modified_base (339): a, t, c or g
  modified_base (354): a, t, c or g
  modified_base (364): a, t, c or g
  modified_base (366): a, t, c or g
  modified_base (369): a, t, c or g
  modified_base (388)..(389): a, t, c or g
  modified_base (391): a, t, c or g
  modified_base (393): a, t, c or g
  modified_base (396): a, t, c or g
  modified_base (410): a, t, c or g
  modified_base (419): a, t, c or g
  modified_base (427): a, t, c or g
  modified_base (435): a, t, c or g
  modified_base (438): a, t, c or g
  modified_base (440): a, t, c or g
  modified_base (442): a, t, c or g
nggcngggaagttaatgccctactggttcnatgctcncacntcnccngtgacnncctgcnccgacccgccgaggtcctgnccgtnaccaccgancnggcgatccgggactctngtacgcatccaacanngancaacgtgcacgggcggagtngtnccgccacttcgncnatgacggggtcgatccnttcgacgtccgtcgccgcgtcggtcgagtggcggtcacnctccnngtactcgaccncacngacgagaggactcgancccatctacgtgtggacgaaacanatcttctgtccnacgactacaccaccacccaggccatcgccgncgcccgcgangccccttcgacgccntactggtccngnggnggcgctctccggttgtctnncncntgncgtgttccttcacncactgcccnacatcgancccgagcnatncnangtccgtcaatc

SEQ ID NO: 684 - DNA, 382 bp, Mycobacterium tuberculosis
  modified_base (209): a, t, c or g
  modified_base (250): a, t, c or g
  modified_base (252): a, t, c or g
  modified_base (254): a, t, c or g
  modified_base (256): a, t, c or g
  modified_base (307): a, t, c or g
  modified_base (349): a, t, c or g
  modified_base (355): a, t, c or g
  modified_base (367): a, t, c or g
ggacactgttcgcgtgcccctcgtcaaagccggagtggtcgtgctgcgccggacccgacccgaccttcagcgggggttcacagctccgtgggtgccgttacttccgatcgccgcagtgtgcgcgtgcctgtggctgatgctgaacctcaccgcgttgacttggatccggttcgggatctggctggtggccggaaccgcgatttatgtcngctacgggcgccggcactcggcgcatggccttcggcaagcncnananaacgcgacccggaggtgttgaactagcttcgccgcgtatttacaaattgcnttatatgtctacacataagacgcaaactgctctattgtcaantcccancgtggtgtggcncatgaagatgtttgg

SEQ ID NO: 685 - DNA, 408 bp, Mycobacterium tuberculosis
  modified_base (32): a, t, c or g
  modified_base (53): a, t, c or g
  modified_base (70): a, t, c or g
  modified_base (87): a, t, c or g
  modified_base (89): a, t, c or g
  modified_base (93): a, t, c or g
  modified_base (122): a, t, c or g
  modified_base (135): a, t, c or g
  modified_base (163): a, t, c or g
  modified_base (195): a, t, c or g
  modified_base (212)..(213): a, t, c or g
  modified_base (224): a, t, c or g
  modified_base (235): a, t, c or g
  modified_base (243): a, t, c or g
  modified_base (248): a, t, c or g
  modified_base (250): a, t, c or g
  modified_base (254): a, t, c or g
  modified_base (259): a, t, c or g
  modified_base (265): a, t, c or g
  modified_base (270): a, t, c or g
  modified_base (282): a, t, c or g
  modified_base (285): a, t, c or g
  modified_base (287): a, t, c or g
  modified_base (303): a, t, c or g
  modified_base (305): a, t, c or g
  modified_base (326): a, t, c or g
  modified_base (328): a, t, c or g
  modified_base (334): a, t, c or g
  modified_base (353): a, t, c or g
  modified_base (358): a, t, c or g
  modified_base (384): a, t, c or g
  modified_base (386): a, t, c or g
  modified_base (408): a, t, c or g
tccttctcggtatcggtttgggctgtcaccancagttggtagttcttcacgtnctgttgttcgagcgtcnagccgtcgcgcgtgtcnangtcnccggacgcgtatcccgccaggccggtcanggtgcccttccantccacgccgctgtggtcggcgaacgctnatcttcaatcgagaccatcgccagcttcatcntgttggcgatcttgtcnnacggcacctcnaaccggcgctnctagtacnccacncnatcntgttnccttcncgtcnacatcctcgatnccncntgcactttccctcgancncctgggccgagccgttggcantnacctcngagccccattggacatcancccancccgcctgcgaacgggaacgtcagcncnctggcgacaacctggccaacan

SEQ ID NO: 686 - DNA, 372 bp, Mycobacterium tuberculosis
  modified_base (4): a, t, c or g
  modified_base (15): a, t, c or g
  modified_base (22): a, t, c or g
  modified_base (31): a, t, c or g
  modified_base (68): a, t, c or g
  modified_base (83): a, t, c or g
  modified_base (116): a, t, c or g
  modified_base (125): a, t, c or g
  modified_base (137): a, t, c or g
  modified_base (153)..(155): a, t, c or g
  modified_base (159): a, t, c or g
  modified_base (162): a, t, c or g
  modified_base (167): a, t, c or g
  modified_base (172): a, t, c or g
  modified_base (183): a, t, c or g
  modified_base (209): a, t, c or g
  modified_base (232): a, t, c or g
  modified_base (237): a, t, c or g
  modified_base (239): a, t, c or g
  modified_base (270): a, t, c or g
  modified_base (289): a, t, c or g
  modified_base (315): a, t, c or g
  modified_base (338): a, t, c or g
  modified_base (342): a, t, c or g
  modified_base (345): a, t, c or g
  modified_base (348): a, t, c or g
  modified_base (353): a, t, c or g
cacnccgtgatcgcnagccccngtagaaatngttgagccagttggtgcggcgctcgttgccggcggtnatctcgtcgagctcntcttccatcgccgcggtgaagtcgtactcgacnagccgaccnaaatgctgctcnagcagaccggttaccnnnaacnccncctcntgacngcaccagtgcnctgcccttcttgtgcacgtacccgcnatcctggatggtcttgatgatcnactantntgtcgacgggcggccgatgcccatctcctcnagcgctttgaccagcgacncctcggtgtatcgggccggcgggttngtggcatggccgtctggggtcanctcnacnatnttcanccgttgacccggggtcaca

SEQ ID NO: 687 - DNA, 403 bp, Mycobacterium tuberculosis
  modified_base (12): a, t, c or g
  modified_base (15): a, t, c or g
  modified_base (20)..(21): a, t, c or g
  modified_base (26)..(27): a, t, c or g
  modified_base (33): a, t, c or g
  modified_base (55): a, t, c or g
  modified_base (59): a, t, c or g
  modified_base (76): a, t, c or g
  modified_base (87): a, t, c or g
  modified_base (92): a, t, c or g
  modified_base (97): a, t, c or g
  modified_base (106): a, t, c or g
  modified_base (116): a, t, c or g
  modified_base (129): a, t, c or g
  modified_base (188): a, t, c or g
  modified_base (208): a, t, c or g
  modified_base (211): a, t, c or g
  modified_base (219): a, t, c or g
  modified_base (221): a, t, c or g
  modified_base (228): a, t, c or g
  modified_base (233): a, t, c or g
  modified_base (241): a, t, c or g
  modified_base (243): a, t, c or g
  modified_base (256): a, t, c or g
  modified_base (267): a, t, c or g
  modified_base (275): a, t, c or g
  modified_base (284): a, t, c or g
  modified_base (302): a, t, c or g
  modified_base (306): a, t, c or g
  modified_base (355): a, t, c or g
  modified_base (357): a, t, c or g
  modified_base (360): a, t, c or g
  modified_base (364): a, t, c or g
  modified_base (383): a, t, c or g
tggccttcttgncangggcnnacatnngctatngcgagcgtgtaaccgatcatcntccnggcgactgtggcctgancggcaagggtngcctnattcntcctcctgnggcatggttnccacacggaatgncggtaagtctggtcggcaacctggcccgctgcgggttgggttcggattcgctcggctantaaggtgctcgcctggtgtnacnactaatcncnatatacncttancgggagtngncgtcccgatcctngccctgccgcnggcgatcncgttcgcancaccgccaccggaactcncaangtgcgctcatcgggctctacgcgccatcttccccggattcttcgcggcngngtnccgngggaccccggactgtgacnggcccaacggctcatcatcg

SEQ ID NO: 688 - DNA, 356 bp, Mycobacterium tuberculosis
  modified_base (38): a, t, c or g
  modified_base (68)..(69): a, t, c or g
  modified_base (114): a, t, c or g
  modified_base (177): a, t, c or g
  modified_base (192): a, t, c or g
  modified_base (209): a, t, c or g
  modified_base (212): a, t, c or g
  modified_base (229): a, t, c or g
  modified_base (239): a, t, c or g
  modified_base (254): a, t, c or g
  modified_base (328): a, t, c or g
ccggatagcggtgtctgaacttcgcccgttccctccancgcattgagcttcagcccgaccggcaggtnnggagtcggcatgcggtccttcgccccgaccccgctggctaaatanccacccccgagcgcggtcacggtctttgcaccgggacgacgcataccggcagcgcgaacatcnccgcgggctgcagcntgaacgtccaataccantcnaacagtgtccgcgcgtnaaaacccganccggcggtcgcttcngtaatcaacggctcctgcgcaaccagctgcaagtcgccggtgccaccggcgttgacgatcttgatgtctgcganctcgcgcaccagctcgacggcccgggca

SEQ ID NO: 689 - DNA, 439 bp, Mycobacterium tuberculosis
cctcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgt

SEQ ID NO: 690 - DNA, 442 bp, Mycobacterium tuberculosis
  modified_base (7): a, t, c or g
  modified_base (35): a, t, c or g
  modified_base (127): a, t, c or g
  modified_base (139): a, t, c or g
  modified_base (145): a, t, c or g
  modified_base (182): a, t, c or g
  modified_base (286): a, t, c or g
  modified_base (314): a, t, c or g
  modified_base (378): a, t, c or g
cttcacntccgtacggctcgggtacgcttcggtcncattgtgcgagtgatagatgacgaccgggacctcgtcggcatcttccatagcccgccacaccttcagttgctcaccggaatccaaccggtanaaggtcggcgancgctcngcattggtcatcgggatatgccgctcgggacggtcanagccctcgggtccggccagcactccgcaggcttcgtcggggtggtcgcgacgcgcatgggccaccatcgcattcaccaggtctgcgcgaatcaccagcacgtanacggttcctttcctaagcaacaccgaantttcaggacccgaatgctccgggaaacatgtcacggtaggtcggtattccggctaccggctgancattgagcacgccggccagcaccgcacgaaccaggcaatcagccgccgccgcacccgaccgcgg

SEQ ID NO: 691 - DNA, 365 bp, Mycobacterium tuberculosis
caggcatgcaagcttgatgccgccgaaaccgagcgtgagcacgccgccagccaccacgcgcgggtcgggcgccgggcccgggccgccaggctgctccgctcggtgatggcacgccaccgcgacaccacccggctgcgctacgtcgagccataccgggcggagctacatcggctcggccgcccagtgttcgggccctctttcgaggtcgaggtcgataccgatttgcgcatccgcagccgcaccctggacgacagaaccgtgccctacgaattgcttgtcgggcggggccaaagaacagcttggcatcctggcgcgattggccggcgcggcgctggtcgccaaggaagacccgttccggtgctgat

SEQ ID NO: 692 - DNA, 307 bp, Mycobacterium bovis
  modified_base (4): a, t, c or g
  modified_base (94): a, t, c or g
  modified_base (142): a, t, c or g
  modified_base (149): a, t, c or g
  modified_base (163): a, t, c or g
  modified_base (188): a, t, c or g
  modified_base (197): a, t, c or g
  modified_base (306): a, t, c or g
aagntcgggtttccacacgcgcggtttgaccctagtcatatgtaatcatgtgtaccatgtgcgggcgcttttcgacggccgcgaaccaccgganatttcctgtgatttcactgcatgcgtaccatctggcacaattgagcanttgtctntcgcggtggtcggncgggttgcgtgccgcctgctgcganatgcaccantaagcccgaacccaccggcttggtgaccaccgcacgctgcgtgtggggggtaaccactccgcgaccccaaggatggtcatttccaatgaaccggctggacttcgtccana

SEQ ID NO: 693 - DNA, 414 bp, Mycobacterium bovis
gtcgcggttcgatcgacccgatcttcacctcgtaacctcgatgcttagcaggatccagcttgaccgcgtttggctctacccactctttgagtggcgccgtcgcctgtgccccatcggtgttcatgacgaacgcttcgaaagacttcctcttgtgagccggaatgtctgcgtaaagaagttccatgtccgggaagtagacccggtcgccctccacgtggtactccttcgaggtccgcttctcgccggatccgataaacaccggccccaggcaccgcagcgtgagttcgaacggcttcaggtaggtgttcatgcggcggactccgggagtgcgagaaatagcggtcgcgcgtagctgtagaccggatggtttccgcccaggctgacgtcgaagatgcctccttggaaggggcgcga

SEQ ID NO: 694 - DNA, 256 bp, Mycobacterium bovis
  modified_base (176): a, t, c or g
aactcaagtttttacggtgatcgcgcatcacctggttcatgaactggaagcagcgcagcgcttccttttcggccgcaacatgagccagcctctcgtcggcggtcgggtgcaggtgctcgggcagctcggccgcgacagccgcctgaccctgaaaccagcttccatatcccgcgacnaacgacgccagtccgctacgtaacccctccgcgactgtccatggacaacagcgcgttctccaccgaccgggcccgggtgt

SEQ ID NO: 695 - DNA, 328 bp, Mycobacterium bovis
  modified_base (62): a, t, c or g
gtgcaggtttcgacaatgtggtgccggttcggcggctacgtgccatcgagacactggcgcangctatcgcacccgttatcggctgcgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtcggctcggatagcgaggtcagcgaattctcgtggcagctcgaaagggtcctgccggtgccggt

SEQ ID NO: 696 - DNA, 278 bp, Mycobacterium bovis
  modified_base (31): a, t, c or g
  modified_base (42): a, t, c or g
ttcgagtcatgcgcccgcctcgaccacgaanatgcacgtcgnggttcgatcgacccgatcttcacctcgtaacctcgatgcttagcaggatccagcttgaccgcgtttggctctacccactctttgagtggcgccgtcgcctgtgccccatcggtgttcatgacgaacgcttcgaaagacttcctcttgtgagccggaatgtctgcgtaaagaagttccatgtccgggaagtagacccggtcgccctccacgtggtactccttcgaggtccgcttctc

SEQ ID NO: 697 - DNA, 264 bp, Mycobacterium bovis
  modified_base (257): a, t, c or g
gtcatgtgtaccatttgcgggcgcttttcgacggccgcgaaacaccggagatttcctgtgatttcactgcatgcgtaccgtctggcacaattgagcagttgtctgtcgcggtggtcggccgggttgcgtgccgcctgctgcgagatgcaccaataagcccgaacccaccggcttggtgaccaccgcacgctgcgtgtggggggtaaccacgccgcgaccccaaggatggtcatttccaatgaaccggctggacttcntcaacaa

SEQ ID NO: 698 - DNA, 169 bp, Mycobacterium bovis
aacagcgcggttgaactgataggtgcggcccggctcgagcaggccgggccatttgttcgatgcggttaccgaaagatctcttcggtgacctgcccgccgccggccagctcggcccagtgcccggcgttggccgccgcggcgacgatcttggcgtccacggtggtcgggg

SEQ ID NO: 699 - DNA, 256 bp, Mycobacterium bovis
  modified_base (151): a, t, c or g
gcatctgggctggcggtggttcgccgctccgaagccgtcgaacaccatcgccagcgcggcttccacatcaacgaccatttcggccagcttgcggcgcatcagcggcttgtcgatgagcgccccaccgaatgcccgccgctgcccggcgtancacagcgattcgaccagcgcgcggcgcgcgttgccgagggcgaacgaagcggtgcccaaccgcaatctgttggtcagctccatcatgcgggtgagtcccttgccg

SEQ ID NO: 700 - DNA, 292 bp, Mycobacterium bovis
  modified_base (39): a, t, c or g
  modified_base (148): a, t, c or g
  modified_base (172): a, t, c or g
atcggtttccagcaacagccgatcgacggcttcgcccanggccgctcccgggcgacccgaccattgctgtcgccgcgtaacgccatcacggatgacgcgcagttcgtcgctgtctagctccaccatcgcctgcacaccggcggccagnacccattggccgtcgcactcgtanagcaggtaatcctcgtcgacggactcggtaaccaccgccgccagctccgctgccaggtcggcggggttgacaccggcgggcatcgggatggacgacgacgcggtgctgacggcgcctgtc

SEQ ID NO: 701 - DNA, 315 bp, Mycobacterium bovis
  modified_base (13): a, t, c or g
agcggtttcccangcgggatgtgctgtgagcgccgcaccaccagcgccgacgctaaggatggaacgcacggcatcttctgacgcgtaaccgcgttgtgatcgcgagctgaggagacggtatgggggagggttctcggaggccatctgggatgttgatgtctgtcgatcttgagccggtgcaactcgtcggcccggacggtacgccgacggccgaacgccgctaccaccgtgaccttcctgaggaaacgctgcgttggctctacgagatgatggtggtcacccgcgagctggataccgaattcgtcaatctgcacg

SEQ ID NO: 702 - DNA, 328 bp, Mycobacterium bovis
  modified_base (293): a, t, c or g
caagcttccacaggtagggatcgaggaacagcgcgttgaactgataggtgcggcccggctcgagcaggccggccatttgttcgatgcggttaccgaaaatctcttcggtgacctgcccgccgccggccagctcggcccagtgcccggcgttggccgccgcggcaacgatcttggcgtccacggtggtcggggtcatgcccgcgagcaggatcggcgagcggccggtcagccgggtgaacttcgtcgaaagcttgaccctgccgtcggggaggcgaaccacggtcggtgcgtanctccaccaagcccgggcaacctcgggggtggcgcc

SEQ ID NO: 703 - DNA, 352 bp, Mycobacterium bovis
tggacctcatgacaacgcggcggcgattacccccgctaccgccagcagcatgacggcggtagcgaacaccgccggatgcagcgcaggtgcgtcgatgtgctcacggaatcgccccggcaccgcgatctcgaggatcaccagtgccaccccctgcagcgcgacaccgacgattccgtacaccgccacgccgatcaggccctgggccagctggcgtatatggcggcgatggtgacgatggccagcgccacatacattgtggcggccagaaccacggcgttggggcggcggtcgatgaacactaggcgacgcagatcgcccggggtcaacaggttgaccatcagaaagcctgcga

SEQ ID NO: 704 - DNA, 315 bp, Mycobacterium bovis
  modified_base (26): a, t, c or g
  modified_base (31): a, t, c or g
tttggtgcggccggcaatcaacttcngctcncagcggtttcccaggcgggatgtgctgtgagcgccgcaccaccagcgccgacgctaaggatggaacgcacggcatcttctgacgcgtaaccgcgttgtgatcgcgagctgaggagacggtatgggggagggttctcggaggccatctgggatgttgatgtctgtcgatcttgagccggtgcaactcgtcggcccggacggtacgccgacggccgaacgccgctaccaccgtgaccttcctgaggaaacgctgcgttggctctacgatatgatggtggtcacccg

SEQ ID NO: 705 - DNA, 390 bp, Mycobacterium bovis
cgcccagggccgctcccgggcgacccgaccattgctgtcgccgcgtaacgccatcacggatgacgcgcagttcgtcgctgtctagctccaccatcgcctgcacaccggcggccaggacccattggccgtcgcactcgtagagcaggtaatcctcgtcgacggactcggtaaccaccgccgccagctccgctgccaggtcggcggggttgacaccggcgggcatcgggatggacgacgacgcggtgctgacggcgcctgtcgcgacgctgagctcggacacagctagtaaatgtagcctaacctacttaatgggtcgcagccccccggggtcgtcgcatgtccaacgttgctcgactggaagaaaatgctcgtcggggagcaaatggcacc

SEQ ID NO: 706 - DNA, 322 bp, Mycobacterium bovis
aatactcaatcttgatcggtttccagcaacagccgatcgacggcttcgcccagggccgctcccgggcgacccgaccattgctgtcgccgcgtaacgccatcacggatgacgcgcagttcgtcgctgtctagctccaccatcgcctgcacaccggcggccaggacccattggccgtcgcactcgtagagcaggtaatcctcgtcgacggactcggtaaccaccgccgccagctccgctgccaggtcggcggggttgacaccggcgggcatcgggatggacgacgacgcggtgctgacggcgcctgtcgcgactctgagctcgg

SEQ ID NO: 707 - DNA, 398 bp, Mycobacterium bovis
ggatgtgctgtgagcgccgcaccaccagcgccgacgctaaggatggaacgcacggcatcttctgacgcgtaaccgcgttgtgatcgcgagctgaggagacggtatgggggagggttctcggaggccatctgggatgttgatgtctgtcgatcttgagccggtgcaactcgtcggcccggacggtacgccgacggccgaacgccgctaccaccgtgaccttcctgaggaaacgctgcgttggctctacgagatgatggtggtcacccgcgagctggataccgaattcgtcaatctgcagcgccagggggaagctggcgttgtacacgccctgtcgcgggcaggaagccgcgcaggtgggtgcggcggcttgcctacgcaaaaccgactggttgttcccc

SEQ ID NO: 708 - DNA, 175 bp, Mycobacterium bovis
  modified_base (93): a, t, c or g
atcacgacaacagcgacggtgtgtcggatcagcggcccccgttgccgggcaatgttgaggcgtttctgcgtctggttgaggccggctgggacnccgaggtggctcgtcggccacatgggcagcacaccaccgtggtgatgcatctagacgtgcaggaccgtgccgctggcctgca

SEQ ID NO: 709 - DNA, 210 bp, Mycobacterium bovis
gcggctacgtgccatcgagacactggcgcaggctatcgcacccgttatcggctgcgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctg

SEQ ID NO: 710 - DNA, 312 bp, Mycobacterium bovis
tacaagcggcacctcgccggtgaactgaccgttcgcacgctgcgcaccgccgccgggcgcgtgctcggcgcgccggcggcccccgaggcctgagaggggaaccaaccatgcaggtgaacatgacggtaaacggcgagcccgtcaccgccgaggtcgaaccccggatgctgctggtccattttctccgtgatcagctgcggctcaccggaactcactggggctgtgataccagcaactgcgggacatgcgtggtggaggtcgacggcgtgccggtgaaatcctgcacgatgctcgccgtgatggcctccgggc

SEQ ID NO: 711 - DNA, 255 bp, Mycobacterium bovis
  modified_base (69): a, t, c or g
  modified_base (72): a, t, c or g
  modified_base (113): a, t, c or g
  modified_base (115): a, t, c or g
  modified_base (142): a, t, c or g
  modified_base (152): a, t, c or g
  modified_base (172): a, t, c or g
  modified_base (183): a, t, c or g
  modified_base (188): a, t, c or g
  modified_base (225): a, t, c or g
  modified_base (255): a, t, c or g
agcggctggttacgactccctgtttgtgatggaccacttctaccaactgcccatgttggggacgcccgnccntccgatgctggaagcctacactgcccttggtgcgctggccncngcgaccgagcggctgcaactgggcgcnttggtgaccngcaatacctaccgcaccccnaccctgctggncaaanatcatcaccacgctcgacttggttagcgccggtcgancgatcctcggcattggaaccggttggtttn

SEQ ID NO: 712 - DNA, 304 bp, Mycobacterium bovis
  modified_base (272): a, t, c or g
acgcgcgccgatcatatctgctatggatgtacaattcagctcttgctgttataccagtatatggtgtactatttgatctatgctgacgtgtgagatgcgggaatcggccctggctcgactcggccgggctctggctgatccgacgcggtgccggattctggtggcgttgctggatggcgtttgctatcccggccagctagctgcgcacctcgggttgacccgatcgaatgtgtccaaccatctgtcgtgtttgcggggctgcgggctggtantcccaacctatgagggccggcaggttcggtat

SEQ ID NO: 713 - DNA, 352 bp, Mycobacterium bovis
ccgcgctgctgctgacgtcggtcgaacgtgcgacacgtctgcgaataccggccgaacgctgggtttatccacaggctggcaccgacgcccacgacacaccggccgtcgccgaccgccaccgactgcatcggtcgacggccattcggatcgccggtgcccgggcgctggaactggctgggctggggctcgatgacatcgaatacgtcgacctgtattcgtgctttccctccgctgtccaagtcgccgcaatcgaactcggcctggacaccgacgatcctgcccgcccgctgaccgtcaccgggggcctgaccttcgccggcgggccgtggagcaattacgtcacgcactccat

SEQ ID NO: 714 - DNA, 233 bp, Mycobacterium bovis
  modified_base (31): a, t, c or g
  modified_base (33): a, t, c or g
  modified_base (105): a, t, c or g
  modified_base (171): a, t, c or g
  modified_base (208): a, t, c or g
  modified_base (220): a, t, c or g
caggcgtgcaatgacctgcactgcgccgganantccctaacccactaaaccggggccgctcacaagccgtgcagctcggtcagcgtcaggtgcgcgaccaggaantaaatgagcagacccgtgccgtcaacgatggtggcgatcatcggccccgaaacgatggccgggtcnatgcgcaacttcttcagcagcggcggaaggacggcanccaccagcgacnaccacaccacgat

SEQ ID NO: 715 - DNA, 336 bp, Mycobacterium bovis
  modified_base (6): a, t, c or g
gcgaancacttcgtcaacttccagggctgcccgcaccaagtatttcgacgagtatttccgtcgggccgccgccgccggcgcgcggcaggtggtcatcctggcggcggggctggactcgcgcgcgtaccggctgccttggcccgacgggaccacggtttttgagctggaccgcccgcaggtccttgatttcaagcgcgaggtgctcgccagccacggtgcccaaccgcgcgccctgcgccgcgagatcgccgtcgacctgcgtgacgattggccacaagccttgcgggacagtggtttcgatgcggctgcaccgtcggcatggattgccgaagggct

SEQ ID NO: 716 - DNA, 273 bp, Mycobacterium bovis
  modified_base (7): a, t, c or g
  modified_base (14): a, t, c or g
  modified_base (20): a, t, c or g
  modified_base (54): a, t, c or g
  modified_base (67): a, t, c or g
  modified_base (72): a, t, c or g
  modified_base (112): a, t, c or g
  modified_base (115): a, t, c or g
  modified_base (150): a, t, c or g
  modified_base (167): a, t, c or g
  modified_base (223): a, t, c or g
  modified_base (234): a, t, c or g
  modified_base (244): a, t, c or g
ttgggcnttgcccncaatanggccccaatcaaaagccgagcaggtggaacctancgcattcgcctcntcgtntgtgcacccgagccatcgcacgcgcgggaattcccggatntcnccgtattctccggcggccgggctaacccatcccangccgaacggttggctcntgccgtgggtcccgtgttggccgatcggggcgtcaccgggggtgctcgggtgcggntgaccatggcnaactgccccnatgggccgaccctggtgcagataaacctg

SEQ ID NO: 717 - DNA, 327 bp, Mycobacterium bovis
  modified_base (20): a, t, c or g
  modified_base (53): a, t, c or g
  modified_base (252): a, t, c or g
tggtggaggtccccaccaanacccggccgtaactctgctcacggaaatgcggncaggccgcgcgtagcacgtggtatccgccataaaggtgcaccttaagcacggcgtcccaattctcgaacgacatcttgtggaaggtgccgtcgcgcaagatcccggcgttgctcaccacaccgtgcacggcgccgaattcgtcaagcgcggtcttgatgatgttcgctgcgccgtcctcggtggcgacgctgtcggtanttggcgaccgcccggccccccttgtcgcgaaatctcggcgacgacctcatcggccatcgccgaaccgggcgcccg

SEQ ID NO: 718 - DNA, 344 bp, Mycobacterium bovis
  modified_base (32): a, t, c or g
  modified_base (55): a, t, c or g
  modified_base (59): a, t, c or g
  modified_base (83): a, t, c or g
  modified_base (146): a, t, c or g
  modified_base (189): a, t, c or g
  modified_base (196): a, t, c or g
  modified_base (198): a, t, c or g
  modified_base (211): a, t, c or g
  modified_base (231): a, t, c or g
  modified_base (266): a, t, c or g
  modified_base (269): a, t, c or g
  modified_base (275): a, t, c or g
  modified_base (292): a, t, c or g
gccggccaaactggccggcggggttgctgtcntcaaggtgggttccgccaccaanaccncactcaaggatcgcaaggaaagcntcaaggatgcggtcgcggccgccaaggccgcggtcaaggagggcatcgtccctggtgggggancctccctcatccaccaggcccgcaaggcgctgaccgaactgcntgcgtcncngaccggtgacaangtcctcggtgtccacgtgtnctccgaagcccttgccgctccgttgttctggatcnccnccaacnctggcttggacggctcngtggtggtcaacaaggtcagcgagctacccgccgggcatgggctgaacgtga

SEQ ID NO: 719 - DNA, 271 bp, Mycobacterium bovis
  modified_base (8): a, t, c or g
  modified_base (37): a, t, c or g
  modified_base (91): a, t, c or g
  modified_base (100): a, t, c or g
  modified_base (121): a, t, c or g
  modified_base (136): a, t, c or g
  modified_base (179): a, t, c or g
  modified_base (196): a, t, c or g
  modified_base (253): a, t, c or g
cgaacctnaattgtcctgtaatgcccagctcaccaangcatggctggtggccggggcggtgaagccggcgtctgcggcaccgtccaactcnatgtggatngccggaatggggatgtccggnacggcgaatccgtanttcgcttgtcccgtgaggcccaggtggatggggggaaggatcntggtgtccgggatgatnatggggccgatgccgccggttgaagtccactggatcgggaattcgggaatcgtgatnccgacgttcaggccgaac

SEQ ID NO: 720 - DNA, 302 bp, Mycobacterium bovis
  modified_base (29): a, t, c or g
  modified_base (167): a, t, c or g
  modified_base (219): a, t, c or g
  modified_base (264): a, t, c or g
ctaacggaatgaaagccctggtggccgtntcggcggtggccgtcgtcgcactgctcggtgtatcttccgcccaagctgatcccgaggcggatcccggcgcaggtgaggccaactatggtggccccccaagttccccacgtcttgtcgatcacaccgaatgggcgcantggggaattctgcccagcctccgggtctacccgtcccaagttgggcgtacancctcccgccgcctcgggatggccgctgccgacccggcctgggccnaggttctcgcgctgtcaccggaagccgacactgccggc

SEQ ID NO: 721 - DNA, 303 bp, Mycobacterium bovis
  modified_base (12): a, t, c or g
  modified_base (17): a, t, c or g
  modified_base (236): a, t, c or g
ccgcgggacacncctcnatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccanacgacatcgtggcgaagattcgccgggtacgccgatgatgtggtgtgtttggcgacgccggcgttgt

SEQ ID NO: 722 - DNA, 280 bp, Mycobacterium bovis
  modified_base (23): a, t, c or g
ctctgggaccggccacggtgccnccggcgttcccggacgtgctgcgccaggtgtccggcggccgcgtgcatggtgttcccggatcggccgctggccagagcccaccggtgaatctggcgcctggccgaccaccgtgcgccgtaggcttgcgatcgtgcagcgctggcgtggccaggacgagatcccgacggattggggcagatgcgtgctcaccatcggggtatttgacggcgtgcaccgcgggcacgccgaactgatcgcgcacgcggtcaaaggcggc

SEQ ID NO: 723 - DNA, 333 bp, Mycobacterium bovis
  modified_base (45): a, t, c or g
  modified_base (64): a, t, c or g
  modified_base (130): a, t, c or g
  modified_base (146): a, t, c or g
  modified_base (205): a, t, c or g
  modified_base (211): a, t, c or g
  modified_base (271): a, t, c or g
  modified_base (309): a, t, c or g
aatactcaagctttcgtcagttcattgcgccagcagaccaacaanagcatcgggacatacggantcaactacccggccaacggtgatttcttggccgccgctgacggcgcgaacgacgccagcgaccacnttcagcaaatggccancgcgtgccgggccacgaggttggtgctcggcggctactcccagggtgcggccgtgatcnacatcntcaccgccgcaccactgcccggcctcgggttcacgcagccgttgccgcccgcagcggacnatcacatcgccgcgatcgccctgttcgggaatccctcnggccgcgctggcgggctgattaac

SEQ ID NO: 724 - DNA, 320 bp, Mycobacterium bovis
  modified_base (112): a, t, c or g
tgccgcggatttggctggctgcccaatattcagaatcgggcctttctttttgcgcgacaataaggtcacagtaaaccctcgttttgtgagatgcggggcgggccgggcgaantcgacctcgagtgaatggatctcgagtgaatggacagggcatcgcctacgagtcgcatccccatccaacagaccggtgctcttgcatcggaccctgaaggtcccgcacggagggtgtggttgccggcgcggggtcacggtgcggtagcgacgtagtgtttgaacgaatttcttgatgctccaacctgtttggtgttcaatccagttct

SEQ ID NO: 725 - DNA, 296 bp, Mycobacterium bovis
  modified_base (3): a, t, c or g
  modified_base (24): a, t, c or g
  modified_base (58): a, t, c or g
  modified_base (60): a, t, c or g
  modified_base (77): a, t, c or g
  modified_base (219): a, t, c or g
  modified_base (229): a, t, c or g
aancttgcgcgctcggccgggtcnagcatccagctgctcggcaaggaggccagctacncntcgctgcgtatgcccagcggtgagatccgccgggtcnacgtccgctgccgcgcgaccgtcggcgaagtgggcaatgccgagcaggcaaacatcaactggggcaaggccggtcggatgcggtggaagggcaagcgcccgtcggtccggggcgtggtgatnaacccggtcnaccacccgcacggcggtggtgagggtaaaacctccggcggccgtcacccggttagcccgtggggcaa

SEQ ID NO: 726 - DNA, 304 bp, Mycobacterium bovis
  modified_base (2): a, t, c or g
antcgaaagtgaccatctctaccttgagtgccataccgcccgaccctatgcctcggatagctcggcggaaagaaacgcttgcagtgccgccgaataggcggctacgtcgtgagcgcccatcaactctcgcgcggagtgcatcgccagctgggcggcgccgacgtcgaccgtggggattccggtgcgcgccgcggccaacggcccgatcgtcgacccgcacggcagatcggcgcgatgttcgtaacgctgcataggcactcccgcgcgctggcaggccagtgcgaacgccgccgcggtgcgtccg

SEQ ID NO: 727 - protein, 318 aa, Mycobacterium sp.
PTQTLTGRPLIGNGTPGAVGSGATGAPGGWLLGDGGAGGSGAAGSGAPGGAGGAAGLWGTGGAGGAGGSSAGGGGAGGAGGAGGWLLGDGGAGGIGGASTVLGGTGGGGGVGGLWGAGGAGGAGGTGLVGGDGGAGGAGGTGGLLAGLIGAGGGHGGTGGLSTNGDGGVGGAGGNAGMLAGPGGAGGAGGDGENLDTGGDGGAGGSAGLLFGSGGAGGAGGFGFLGGDGGAGGNAGLLLSSGGAGGFGGFGTAGGVGGAGGNAGWLGFGGAGGVGGSAGLIGTGGNGGNGGTGANAGSPGTGGAGGLLLGQNGLNGLP

SEQ ID NO: 728 - protein, 334 aa, Mycobacterium sp.
PTQTLTGRPLIGNGTPGAVGSGATGAPGGWLLGDGGAGGSGAAGSGAPGGAGGAAGLWGTGGAGGIGGASTVLGGTGGGGGVGGLWGAGGAGGAGGTGLVGGDGGAGGAGGTGGLLAGLIGAGGGHGGTGGLSTNGDGGVGGAGGNAGMLAGPGGAGGAGGDGENLDTGGDGGAGGSAGLLFGSGGAGGAGGFGFLGGDGGAGGNAGLLLSSGGAGGFGGFGTAGGVGGAGGNAGWLGFGAGGIGGIGGNANGGAGGNGGTGGQLWGSGGAGVEGGAALSVGDTGGAGGVGGSAGLIGTGGNGGNGGTGANAGSPGTGGAGGLLLGQNGLNGLP

SEQ ID NO: 729 - DNA, 650 bp, Mycobacterium sp.
gcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcga

SEQ ID NO: 730 - protein, 8 aa, Mycobacterium sp.
  MOD_RES (2): Any amino acid
  MOD_RES (4): Any amino acid
  MOD_RES (7): Any amino acid
NXGXGNXG

SEQ ID NO: 731 - protein, 9 aa, Mycobacterium sp.
  MOD_RES (2)..(3): Any amino acid
  MOD_RES (7)..(8): Any amino acid
GXXSVPXXW

SEQ ID NO: 732 - protein, 29 aa, Mycobacterium sp.
GGAGGAGGSSAGGGGAGGAGGAGGWLLGD

SEQ ID NO: 733 - protein, 45 aa, Mycobacterium sp.
GAGGIGGIGGNANGGAGGNGGTGGQLWGSGGAGVEGGAALSVGDT

SEQ ID NO: 734 - DNA, 21 bp, Mycobacterium sp.
agttagctcactcattaggca

SEQ ID NO: 735 - DNA, 21 bp, Mycobacterium sp.
ggatgtgctgcaaggcgatta

SEQ ID NO: 736 - DNA, 27 bp, Mycobacterium sp.
aaacagctatgaccatgattacgccaa

SEQ ID NO: 737 - DNA, 24 bp, Mycobacterium sp.
tcctctagagtcgacctgcaggca

SEQ ID NO: 738 - DNA, 18 bp, Mycobacterium sp.
  modified_base (7)..(12): a, t, c or g
tctagannnnnntccggc

SEQ ID NO: 739 - DNA, 18 bp, Mycobacterium sp.
  modified_base (7)..(12): a, t, c or g
tctagannnnnngggccc

SEQ ID NO: 740 - DNA, 20 bp, Mycobacterium sp.
  modified_base (9)..(13): a, t, c or g
cgtttaaannnnnwaggccg

SEQ ID NO: 741 - DNA, 21 bp, Mycobacterium sp.
  modified_base (10)..(14): a, t, c or g
ggtactagtnnnnnwtccggc

SEQ ID NO: 742 - DNA, 22 bp, Mycobacterium sp.
acgacctcatattccgaatccc

SEQ ID NO: 743 - DNA, 23 bp, Mycobacterium sp.
gcatctgttgagtacgcacttcc

SEQ ID NO: 744 - DNA, 693 bp, Mycobacterium tuberculosis
ttgaagaaagtcgcgattgttcaatcaaattacataccttggcgaggatattttgacctgattgcattcgtcgatgaattcatcatctatgatgacatgcaatataccaagcgtgattggcgaaacagaaatcggatcaaaacgagccaggggttacagtggataactgttcccgtccaggtgaagggacgtttccatcaaaagatacgtgagacgctgatcgacggcaccgattgggcgaaagcgcactggcgggcactagaattcaactacagcgcggccgctcattttgcggagatcgctgactggctcgcgccgatttacctcgaagaacagcacacgaatctttccttactcaacaggcgtctattgaatgcgatttgcagttatctcggtatcagcacgcgactggcaaattcgtgggactacgaattagccgacggcaagaccgagagactggccaacctctgccaacaggccgcagcgaccgaatatgtctctggcccctcagcccgttcgtatgtcgatgagcgcgtgttcgacgaacttagcatccgggtaacttggttcgattatgacggctaccgcgattataagcaattgtggggagggttcgagcccgccgtgtcgattctggatctgctctttaacgtcggagccgaggctccggactatttgaggtactgtcgccag

SEQ ID NO: 745 - DNA, 1797 bp, Mycobacterium tuberculosis
gtgattccggtgatgagcgctcgcttcactgggttcccgctcctgccggtcgctcttcgccatggcataacgtcggggcgtggctgtgggttcatcctagatgtcggtgcccagcgccctttcggcaacgacgtcctgttgtcggttgccacgaggaagatccggtctagactgcccggcgaccgcgttggcaaccatggcgctctgctaccgtttcgcgcagaaccgaggagaatccagatgaagcgacccccggaggtgttgcgcggtgccgtgaccgcgagccgggagcggctctgggcgatcggctcccaatccgagcgcaccctcatgctcggcaccatcctgctggcgtcggtgatttcggcggcgacggcgtacgccctcagtcagtggtacgcggtcgacgtcttttccactcttttggtagtccctggggactgttggcttgattggggcatgaatatcggtcggcactgcttcagcgactacgccatggtcgccgccgccgggattcaacccaatcccgcggactacctgatctcgctacccgccgattaccagccgaccgcggttgctgcatgggcccccgcccgcataccgtatgcgattttcggactacccagccattggctgggtgcgccgcgcttggggctgatctgttacctggtcgccctaacgatggcggtcatatctcccgccatctgggcggcccggggggcacgtggtctggagcgagtggtcatcttcgtgacactgggcgccgcggccatcccggcgtggggggtcatcgatcgaggcaactcgacagggttcgtggtaccgatcgcgctggcttacttcgtggcgttgtcccgacagcggtggggcctcgccaccatcacggtgatcttggccgtcctggtaaagccgcagttcgtcgttctcggcgtggtgttgttggcggctcgacaatggcggtgggctggtatcgggatcaccggcgtggtggtgtccaatatcgcagcctttctgttgtggccacgaggcttcccggggacgatcgcacagtcgatccacggcatcatcaagttcaatagttcgttcggagggcttcgagacccgcggaacgtgtcctttggcaaggcactcctgctgatccccgatagcatcaagaactatcaatcgggcaagatcccagagggtttcctcactggtccgcgaacgcagatcgggtttgctgtcctagtcatagtcgtggtcgccgtgctggcgctcggacgccgtatcccgcctgtcatggtggggattgtgttgctcgccaccgccaccttctcccccgcggacgtcgccttctactatctcgttttcgtcttgccaatcgctgcactggtagcccgagaccccaacgggcctcctggtgctgggatattcgaccaactcgcagcccatggagaccgccgccgcgcggtcggcgtctgcgtgagtttggccgtggcgctgagcatcgtcaacgtcgcggtcccgggccagccgttctacgtgccgctctatggacagctgggagccaaaggggtagtcggtaccacgccactcgttttcaccacggtgacatgggcaccgttcttgtggttggtcacgtgcgtagtaatcatcgtctcctacgcgcgcaaacccgctcgcccacatgacagtcacaacgggcctactcgggagagcgaccaggacaccgctgccagcaccacctcatgcttacccaatccggttgaggagtcctcaccacggggacccggcccaatctgccaaaattacacccca

SEQ ID NO: 746 - DNA, 879 bp, Mycobacterium tuberculosis
gtgtttgcgttgagtaataatctgaaccgtgtgaacgcatgcatggatggattccttgcccgtatccgctcacatgttgatgcgcacgcgccagaattgcgttcactgttcgatacgatggcggccgaggcccgatttgcacgcgactggctgtccgaggacctcgcgcggttgcctgtcggtgcagcattgctggaagtgggcgggggggtacttctgctcagctgtcaactggcggcggagggatttgacatcaccgccatcgagccgacgggtgaaggttttggcaagttcagacagcttggcgacatcgtgctggaattggctgcagcacgacccaccatcgcgccatgcaaggcggaagactttatttccgagaagcggttcgacttcgccttctcgctgaatgtgatggagcacatcgaccttccggatgaggcagtcaggcgggtatcggaagtgctgaaaccgggggccagttaccacttcctgtgcccgaattacgtattcccgtacgaaccgcatttcaatatcccaacattcttcaccaaagagctgacatgccgggtgatgcgacatcgcatcgagggcaatacgggcatggatgacccgaagggagtctggcgttcgctcaactggattacggttcccaaggtgaaacgctttgcggcgaaggatgcgacgctgaccttgcgcttccaccgtgcaatgttggtatggatgctggaacgcgcgctgacggataaggaattcgctggtcgccgggcacaatggatggtcgctgctattcgctcggcggtgaaattgcgtgtgcatcatctggcaggctatgttcccgctacgctgcagcccatcatggatgtgcggctaacgaagagg

SEQ ID NO: 747 - DNA, 1296 bp, Mycobacterium tuberculosis
atgtacgagagacggcatgagcgcggaatgtgcgaccgtgccgtcgagatgaccgacgtcggcgctacggcagcccccaccggacctatcgcgcggggcagcgtcgctcgggtcggcgcggcgaccgcgttggccgttgcctgcgtctacacggtcatctatctggcggcccgcgacctacccccggcttgtttttcgatattcgcggtgttttggggggcgctcggcattgccaccggcgccacccacggcctcctgcaagaaacgacccgcgaggtccgctgggtgcgctccacccaaatagttgcgggccatcgtacccatccgctgcgggtggccgggatgattggcaccgtcgcggccgtcgtaattgcgggtagctcaccgctgtggagccgacagctattcgtcgaggggcgctggctgtccgtggggctactcagcgttggggtggccgggttctgcgcgcaggcgaccctgctgggcgcgctggccggcgtcgaccggtggacacagtacgggtcactgatggtgaccgacgcggtcatccggttggcggtcgccgcggcagcggttgtgatcggatggggtctggccgggtacttgtgggccgccaccgcgggagcggtggcgtggctgctcatgctgatggcctcgcccaccgcgcgcagcgcggccagcctgctgacgcccgggggaatcgccacgttcgtgcgcggtgccgctcattcgataaccgccgcgggtgccagcgcgattctggtaatgggtttcccagtgttgctcaaagtgacctccgaccagttaggggcaaagggcggagcggtcatcctggctgtgaccttgacgcgtgcgccgcttctggtcccactgagcgcgatgcaaggcaacctgatcgcgcatttcgtcgaccggcgcacccaacggcttcgggcgctgatcgcaccggcgctggtcgtcggcggcatcggtgcggtcgggatgttggccgcagggcttaccggtccctggttgctgcgtgttggattcggccccgactaccaaactggcggggcgttgctggcctggttgacggcagcggcggtagctatcgccatgctgacgctgaccggcgccgccgcggtcgcggccgcactgcaccgggcgtatttgctgggctgggtcagcgcgacggtggcgtcgacgctgttgctgctgctgccgatgccgctggagacgcgcaccgtgatcgcgctgttgttcggtccaacggtgggaatcgccatccatgtggccgcgttggcgcggcgacccgac

SEQ ID NO: 748 - DNA, 1020 bp, Mycobacterium tuberculosis
gtgaagcgagcgctcatcaccggaatcaccggccaggacggctcgtatctcgccgaactgctgctggccaaggggtatgaggttcacgggctcatccggcgcgcttcgacgttcaacacctcgcggatcgatcacctctacgtcgacccgcaccaaccgggcgcgcggctgtttctgcactatggtgacctgatcgacggaacccggttggtgaccctgctgagcaccatcgaacccgacgaggtgtacaacctggcggcgcagtcacacgtgcgggtgagcttcgacgaacccgtgcacaccggtgacaccaccggcatgggatccatgcgactgctggaagccgttcggctctctcgggtgcactgccgcttctatcaggcgtcctcgtcggagatgttcggcgcctcgccgccaccgcagaacgagctgacgccgttctacccgcggtcaccgtatggcgccgccaaggtctattcgtactgggcgacccgcaattatcgcgaagcgtacggattgttcgccgttaacggcatcttgttcaatcacgaatcaccgcggcgcggtgagacgttcgtgacccgaaagatcaccagggccgtggcacgcatcaaggccggtatccagtccgaggtctatatgggcaatctggatgcggtccgcgactgggggtacgcgcccgaatacgtcgaaggcatgtggcggatgctgcagaccgacgagcccgacgacttcgttttggcgaccgggcgcggtttcaccgtgcgtgagttcgcgcgggccgcgttcgagcatgccggtttggactggcagcagtacgtgaaattcgaccaacgctatctgcggcccaccgaggtggattcgctgatcggcgacgcgaccaaggctgccgaattgctgggctggagggcttcggtgcacactgacgagttggctcggatcatggtcgacgcggacatggcggcgctggagtgcgaaggcaagccgtggatcgacaagccgatgatcgccggccggaca

SEQ ID NO: 749 - DNA, 966 bp, Mycobacterium tuberculosis
atgaacgcgcacacctcggtcggcccgcttgaccgcgcggcccgggtctacatcgccgggcatcgcggcctggtcgggtccgcgctgctacgcacgtttgcgggcgcggggttcaccaacctgctggtgcggtcacgcgccgagcttgatctgacggatcgggccgcgacgttcgacttcgttctcgagtcgaggccgcaggtcgtcatcgacgcggcggcccgggtcggcggcatcctggccaacgacacctacccggccgatttcctgtcggaaaacctccagatccaggtcaacctgctggatgccgccgtggcggcgcgggtgccgcggctgctgttcctgggctcgtcgtgcatctacccgaaactcgccccgcagccgatcccggagagcgcgctgctcaccggtccgttggagccgaccaacgacgcgtacgcgatcgccaaaatcgccggcatccttgcggtccaggcggtgcgccgccaacatggcctgccgtggatctcggcgatgcccaccaacctgtacgggccaggcgacaacttttcgccgtccggctcgcatctgctgccggcactcatccgccgctatgacgaggccaaagccagtggcgcgcccaacgtgaccaactggggcaccggcacgccccgacgggagttgctgcacgtcgacgacctggcgagcgcatgcctgtatctgctggaacatttcgacgggccgacccatgtcaacgtgggaaccggcatcgaccacaccatcggcgagatcgccgagatggtcgcctcggcggtaggctatagcggcgaaacccgctgggatccaagcaaaccggacggaacaccacgcaaactgctggatgtttcggtgctacgggaggcgggatggcggccttcgatcgcgctgcgcgacggcatcgaggcgacggtggcgtggtatcgcgagcacgcgggaacggttcggcaa

SEQ ID NO: 750 - DNA, 729 bp, Mycobacterium tuberculosis
atgaggctggcccgtcgcgctcggaacatcttgcgtcgcaacggcatcgaggtgtcgcgctactttgccgaactggactgggaacgcaatttcttgcgccaactgcaatcgcatcgggtcagtgccgtgctcgatgtcggggccaattcggggcagtacgccaggggtctgcgcggcgcgggcttcgcgggccgcatcgtctcgttcgagccgctgcccgggccctttgccgtcttgcagcgcagcgcctccacggacccgttgtgggaatgccggcgctgtgcgctgggcgatgtcgatggaaccatctcgatcaacgtcgccggcaacgagggcgccagcagttccgtcttgccgatgttgaaacgacatcaggacgcctttccaccagccaactacgtgggcgcccaacgggtgccgatacatcgactcgattccgtggctgcagacgttctgcggcccaacgatattgcgttcttgaagatcgacgttcaaggattcgagaagcaggtgatcgcgggtggcgattcaacggtgcacgaccgatgcgtcggcatgcagctcgagctgtctttccagccgttgtacgagggtggcatgctcatccgcgaggcgctcgatctcgtggattcgttgggctttacgctctcgggattgcaacccggtttcaccgacccccgcaacggtcgaatgctgcaggccgatggcatcttcttccggggcagcgat

SEQ ID NO: 751 - DNA, 786 bp, Mycobacterium tuberculosis
gtgacgtctgctccgaccgtctcggtgataacgatctcgttcaacgacctcgacgggttgcagcgcacggtgaaaagtgtgcgggcgcaacgctaccggggacgcatcgagcacatcgtaatcgacggtggcagcggcgacgacgtggtggcatacctgtccgggtgtgaaccaggcttcgcgtattggcagtccgagcccgacggcgggcggtacgacgcgatgaaccagggcatcgcgcacgcatcgggtgatctgttgtggttcttgcactccgccgatcgtttttccgggcccgacgtggtagcccaggccgtggaggcgctatccggcaagggaccggtgtccgaattgtggggcttcgggatggatcgtctcgtcgggctcgatcgggtgcgcggcccgatacctttcagcctgcgcaaattcctggccggcaagcaggttgttccgcatcaagcatcgttcttcggatcatcgctggtggccaagatcggtggctacgaccttgatttcgggatcgccgccgaccaggaattcatattgcgggccgcgctggtatgcgagccggtcacgattcggtgtgtgctgtgcgagttcgacaccacgggcgtcggctcgcaccgggaaccaagcgcggtcttcggtgatctgcgccgcatgggcgaccttcatcgccgctacccgttcgggggaaggcgaatatcacatgcctacctacgcggccgggagttctacgcctacaacagtcgattctgggaaaacgtcttcacgcgaatgtcgaaa

SEQ ID NO: 752 - DNA, 894 bp, Mycobacterium tuberculosis
atgtcgacaaacccaggaccagccgaaggggctaaccaagtgatggcacaggaacattcggccggcgcggtacaattcaccgcccacaacgttcgcctcgacgacggaaccttgacgataccggagtcctcgcgcacgttagacgaatcgtcctggttcatctcggcgcgcgggattctggaaaccgtctttcccggggacaagagccacctacgcctggccgatgtcggctgcttggaaggcgggtacgcggtcgggttcgcgcgcatgggatttcaggtcctcgggatcgaggttcgcgagctgaacatggcggcctgcaactacatcaaatcgaagaccaacctgccgaatctccggttcgtccacgacaacgccctcaacatcgccaaccacgggctcttcgataccgtcttctgctgcggcctcttctaccacctggagaatccgaagcaatacctggaaaccctctcgtcggtaacgaacaagctgctgattctccagacgcacttctcgatcatcaaccggagcgataaatggctccggttgcccacgacggcacgacaattgaccgatcggttgctgcggcggccggcgccggtgaagttcatgctctcggcgcccaccgaacatgagggacttcccggtaggtggtttaccgagttttccgacgaccgctcgtttggccagcgcgacaccgcaaaatgggcgtcctgggacaatcgccggtcattctggattcaacgcgagcacctacttcaggccatcaaagacgtcggcgtcgacctggtgatggaggagtacgacaacttggaaccaagcatcgccgagtcgttgctcggaggttcctatgcggcgaatcttcgaggcaccttcatcggtatcaagacccgg

SEQ ID NO: 753 - DNA, 1119 bp, Mycobacterium tuberculosis
gtgccgtacgtccgccgaccaccaggccacgacggccgacggccggcgggcacaggcgattcacgttcgccatcgcaatacccttgcggccgcgcaggaaaagggccgacggtgagtccccagctttgccccaaggtgagcatcgtctcgaccactcacaaccaggcgggctacgcccgtcaggccttcgacagctttctcgaccagcaaaccgacttcccggtggagatcatcgtcgccgacgacgcgtcgaccgatgccaccccggcgatcatccgtgagtacgccgagcggtacccgcacgtgttccggccgatcttcaggaccgaaaacctcggcctcaatgggaacctgaccggcgccctgtcggccgctcgcggcgagtacgtcgcgttgtgcgaggcggacgactactggatcgatccgctgaagctaagcaaacaggtcgcattcctcgaccggcaccccaagacgacggtgtgcttccatcccgtccgagtgatatgggaggacggccatgccaaggactcgaagttccccccggttcgggtgcggggcaacttgagcctggatgcgttgatcttgatgaacttcatccagaccaactcggccgtgtaccgtcgcctcgagcgctacgacgacattcctgccgacgtcatgcccctggactggtatctgcacgtccggcacgcggtgcatggcgacatcgccatgttgcccgacaccatggccgtgtatcgccgccacgcccaaggcatgtggcacaaccaggtggtggacccgccaaagttctggttgacgcagggtccggggcatgcggcgacgtttgacgcgatgctcgacctgttcccgggagaccccgcgcgcgaggagctcatcgccgtcatggccgactggatccttcgccagatcgccaacgttccaggcccggaggggcgcgccgcgctgcaggaaaccatcgcgcgccatccccggatcgccatgctggcgctgcagcaccgcggggcgacacccgcgcggcggctcaagacccagtggcgcaagctcgccgccgcgacgccgagccgcagggggctcgtggatgtgtggccctcccggctccgacgcggctgtcgagcc

SEQ ID NO: 754 - DNA, 18 bp, Mycobacterium tuberculosis
gcgcaacactcttggagt

SEQ ID NO: 755 - DNA, 19 bp, Mycobacterium tuberculosis
ggcctacaacggcgctctc

---

The invention claimed is:

1. A purified polypeptide, encoded by a polynucleotide comprising an Open Reading Frame contained within SEQ ID NO:1, wherein the polynucleotide is selected from:

(a) nucleotide 1,696,019 through nucleotide 1,697,420 of the *Mycobacterium tuberculosis* chromosome;

(b) nucleotide 1,696,019 through nucleotide 1,699,892 of the *Mycobacterium tuberculosis* chromosome;

(c) nucleotide 1,696,019 through nucleotide 1,701,088 of the *Mycobacterium tuberculosis* chromosome;

(d) nucleotide 1,696,019 through nucleotide 1,702,588 of the *Mycobacterium tuberculosis* chromosome;

(e) nucleotide 1,696,019 through nucleotide 1,704,091 of the *Mycobacterium tuberculosis* chromosome;

(f) nucleotide 1,696,019 through nucleotide 1,705,056 of the *Mycobacterium tuberculosis* chromosome;

(g) nucleotide 1,696,019 through nucleotide 1,705,784 of the *Mycobacterium tuberculosis* chromosome;

(h) nucleotide 1,696,019 through nucleotide 1,706,593 of the *Mycobacterium tuberculosis* chromosome;

(i) nucleotide 1,696,019 through nucleotide 1,707,524 of the *Mycobacterium tuberculosis* chromosome; or (j) nucleotide 1,696,019 through nucleotide 1,708,648 of the *Mycobacterium tuberculosis* chromosome.

2. A purified polypeptide, encoded by a polynucleotide, comprising an Open Reading Frame contained within SEQ ID NO:1, wherein the polynucleotide is selected from:

(a) nucleotide 1,696,728 through nucleotide 1,708,746 of the *Mycobacterium tuberculosis* chromosome;

(b) nucleotide 1,698,096 through nucleotide 1,708,746 of the *Mycobacterium tuberculosis* chromosome;

(c) nucleotide 1,700,210 through nucleotide 1,708,746 of the *Mycobacterium tuberculosis* chromosome;

(d) nucleotide 1,701,293 through nucleotide 1,708,746 of the *Mycobacterium tuberculosis* chromosome;

(e) nucleotide 1,703,072 through nucleotide 1,708,746 of the *Mycobacterium tuberculosis* chromosome;

(f) nucleotide 1,704,091 through nucleotide 1,708,746 of the *Mycobacterium tuberculosis* chromosome;

(g) nucleotide 1,705,056 through nucleotide 1,708,746 of the *Mycobacterium tuberculosis* chromosome;

(h) nucleotide 1,705,808 through nucleotide 1,708,746 of the *Mycobacterium tuberculosis* chromosome;

(i) nucleotide 1,706,631 through nucleotide 1,708,746 of the *Mycobacterium tuberculosis* chromosome; or (j) nucleotide 1,707,530 through nucleotide 1,708,746 of the *Mycobacterium tuberculosis* chromosome.

3. A purified polypeptide, encoded by a polynucleotide, comprising an Open Reading Frame contained within SEQ ID NO:1, wherein the polynucleotide is selected from:

(a) nucleotide 1,696,019 through nucleotide 1,698,096 of the *Mycobacterium tuberculosis* chromosome;

(b) nucleotide 1,696,019 through nucleotide 1,700,210 of the *Mycobacterium tuberculosis* chromosome;

(c) nucleotide 1,696,019 through nucleotide 1,701,293 of the *Mycobacterium tuberculosis* chromosome;

(d) nucleotide 1,696,019 through nucleotide 1,703,072 of the *Mycobacterium tuberculosis* chromosome;

(e) nucleotide 1,696,019 through nucleotide 1,704,091 of the *Mycobacterium tuberculosis* chromosome;

(f) nucleotide 1,696,019 through nucleotide 1,705,056 of the *Mycobacterium tuberculosis* chromosome;

(g) nucleotide 1,696,019 through nucleotide 1,705,808 of the *Mycobacterium tuberculosis* chromosome;

(h) nucleotide 1,696,019 through nucleotide 1,706,631 of the *Mycobacterium tuberculosis* chromosome; or (i) nucleotide 1,696,019 through nucleotide 1,707,530 of the *Mycobacterium tuberculosis* chromosome.

4. A purified polypeptide, encoded by a polynucleotide, comprising an Open Reading Frame contained within SEQ ID NO:1, wherein the polynucleotide is selected from:

(a) nucleotide 1,696,441 through nucleotide 1,708,746 of the *Mycobacterium tuberculosis* chromosome;

(b) nucleotide 1,697,420 through nucleotide 1,708,746 of the *Mycobacterium tuberculosis* chromosome;

(c) nucleotide 1,699,892 through nucleotide 1,708,746 of the *Mycobacterium tuberculosis* chromosome;

(d) nucleotide 1,701,088 through nucleotide 1,708,746 of the *Mycobacterium tuberculosis* chromosome;

(e) nucleotide 1,702,588 through nucleotide 1,708,746 of the *Mycobacterium tuberculosis* chromosome;

(f) nucleotide 1,704,091 through nucleotide 1,708,746 of the *Mycobacterium tuberculosis* chromosome;

(g) nucleotide 1,705,056 through nucleotide 1,708,746 of the *Mycobacterium tuberculosis* chromosome;

(h) nucleotide 1,705,784 through nucleotide 1,708,746 of the *Mycobacterium tuberculosis* chromosome;

(i) nucleotide 1,707,524 through nucleotide 1,708,746 of the *Mycobacterium tuberculosis* chromosome; or (j) nucleotide 1,706,593 through nucleotide 1,708,746 of the *Mycobacterium tuberculosis* chromosome.

5. A purified polypeptide encoded by a polynucleotide, comprising an Open Reading Frame contained within SEQ ID NO: 1, wherein the polynucleotide consists of ORF6 between nucleotide 1,703,072 through nucleotide 1,704,091.

* * * * *